(12) United States Patent
Walker et al.

(10) Patent No.: US 11,192,940 B2
(45) Date of Patent: Dec. 7, 2021

(54) COMPOUNDS SPECIFIC TO CORONAVIRUS S PROTEIN AND USES THEREOF

(71) Applicant: Adagio Therapeutics, Inc., Waltham, MA (US)

(72) Inventors: Laura Walker, Lebanon, NH (US); Laura Deveau, Lebanon, NH (US); Jonathan Belk, Lebanon, NH (US); Anna Wec, Lebanon, NH (US); C. Garrett Rappazzo, Lebanon, NH (US)

(73) Assignee: Adagio Therapeutics, Inc., Waltham, MA (US)

( * ) Notice: Subject to any disclaimer, the term of this patent is extended or adjusted under 35 U.S.C. 154(b) by 0 days.

(21) Appl. No.: 17/226,153

(22) Filed: Apr. 9, 2021

(65) Prior Publication Data

US 2021/0324048 A1 Oct. 21, 2021

Related U.S. Application Data

(60) Provisional application No. 63/163,400, filed on Mar. 19, 2021, provisional application No. 63/152,054, filed on Feb. 22, 2021, provisional application No. 63/150,413, filed on Feb. 17, 2021, provisional application No. 63/148,754, filed on Feb. 12, 2021, provisional application No. 63/147,495, filed on Feb. 9, 2021, provisional application No. 63/143,456, filed on Jan. 29, 2021, provisional application No. 63/138,886, filed on Jan. 19, 2021, provisional application No. 63/112,122, filed on Nov. 10, 2020, provisional application No. 63/046,313, filed on Jun. 30, 2020, provisional application No. 63/021,589, filed on May 7, 2020, provisional application No. 63/008,545, filed on Apr. 10, 2020.

(51) Int. Cl.
C07K 16/10 (2006.01)

(52) U.S. Cl.
CPC .......... *C07K 16/10* (2013.01); *C07K 2317/54* (2013.01); *C07K 2317/55* (2013.01); *C07K 2317/565* (2013.01); *C07K 2317/622* (2013.01); *C07K 2317/76* (2013.01); *C07K 2317/92* (2013.01)

(58) Field of Classification Search
CPC .............. C07K 16/10; C07K 2317/76; C07K 2317/622; C07K 2317/565; C07K 2317/55; C07K 2317/54; C07K 2317/92
See application file for complete search history.

(56) References Cited

U.S. PATENT DOCUMENTS

| | | | |
|---|---|---|---|
| 11,097,002 | B2 | 8/2021 | He et al. |
| 2008/0248043 | A1 | 10/2008 | Babcook et al. |
| 2014/0212421 | A1 | 7/2014 | Hulmann-Cottier et al. |
| 2018/0118803 | A1 | 5/2018 | Brentjens et al. |
| 2021/0261650 | A1 | 8/2021 | Corti et al. |
| 2021/0275664 | A1 | 9/2021 | Graham et al. |

FOREIGN PATENT DOCUMENTS

| | | |
|---|---|---|
| WO | 2021/148884 A1 | 7/2021 |
| WO | 2021/156490 A2 | 8/2021 |
| WO | 2021/158521 A1 | 8/2021 |
| WO | 2021/163438 A1 | 8/2021 |
| WO | 2021/173753 A1 | 9/2021 |

OTHER PUBLICATIONS

Meulen et al, PLoS Medicien 3: 1071-1079, 2006 (Year: 2006).*
International Search Report and Written Opinion for Application No. PCT/US2021/026574, dated Sep. 21, 2021, 14 pages.

* cited by examiner

*Primary Examiner* — Lei Yao
(74) *Attorney, Agent, or Firm* — McCarter & English, LLP; Marcie B. Clarke

(57) ABSTRACT

The present disclosure is directed to antibodies, and antigen binding fragments thereof, having binding specificity for the S protein of coronaviruses (CoV-S), such as the S protein of the SARS coronavirus (SARS-CoV-S) and/or the S protein of the SARS coronavirus 2 (SARS-CoV-2-S), including neutralizing antibodies and antibodies that bind to and/or compete for binding to the same linear or conformational epitope(s) on CoV-S. Further disclosed are conjugates of anti-CoV-S antibodies, and binding fragments thereof, conjugated to one or more functional or detectable moieties. Methods of making said anti-CoV-S antibodies and antigen binding fragments thereof are also contemplated. Other embodiments of the disclosure include the use of anti-CoV-S antibodies, and binding fragments thereof, for the diagnosis, assessment, and treatment of diseases and disorders associated with coronaviruses, or the S protein thereof, and conditions where neutralization or inhibition of coronaviruses, or the S protein thereof, would be therapeutically and/or prophylactically beneficial.

14 Claims, 291 Drawing Sheets
Specification includes a Sequence Listing.

| ADI ID | VH Protein SEQ ID NO. | VH FR1 Protein SEQ ID NO. | VH CDR1 Protein SEQ ID NO. | VH FR2 Protein SEQ ID NO. | VH CDR2 Protein SEQ ID NO. | VH FR3 Protein SEQ ID NO. | VH CDR3 Protein SEQ ID NO. | VH FR4 Protein SEQ ID NO. | VH DNA SEQ ID NO. |
|---|---|---|---|---|---|---|---|---|---|
| ADI-55688 | 102 | 103 | 104 | 105 | 106 | 107 | 108 | 109 | 110 |
| ADI-55689 | 202 | 203 | 204 | 205 | 206 | 207 | 208 | 209 | 210 |
| ADI-55690 | 302 | 303 | 304 | 305 | 306 | 307 | 308 | 309 | 310 |
| ADI-55691 | 402 | 403 | 404 | 405 | 406 | 407 | 408 | 409 | 410 |
| ADI-55692 | 502 | 503 | 504 | 505 | 506 | 507 | 508 | 509 | 510 |
| ADI-55693 | 602 | 603 | 604 | 605 | 606 | 607 | 608 | 609 | 610 |
| ADI-55694 | 702 | 703 | 704 | 705 | 706 | 707 | 708 | 709 | 710 |
| ADI-55695 | 802 | 803 | 804 | 805 | 806 | 807 | 808 | 809 | 810 |
| ADI-55696 | 902 | 903 | 904 | 905 | 906 | 907 | 908 | 909 | 910 |
| ADI-55697 | 1002 | 1003 | 1004 | 1005 | 1006 | 1007 | 1008 | 1009 | 1010 |
| ADI-55698 | 1102 | 1103 | 1104 | 1105 | 1106 | 1107 | 1108 | 1109 | 1110 |
| ADI-55699 | 1202 | 1203 | 1204 | 1205 | 1206 | 1207 | 1208 | 1209 | 1210 |
| ADI-55700 | 1302 | 1303 | 1304 | 1305 | 1306 | 1307 | 1308 | 1309 | 1310 |
| ADI-55701 | 1402 | 1403 | 1404 | 1405 | 1406 | 1407 | 1408 | 1409 | 1410 |
| ADI-55702 | 1502 | 1503 | 1504 | 1505 | 1506 | 1507 | 1508 | 1509 | 1510 |
| ADI-55703 | 1602 | 1603 | 1604 | 1605 | 1606 | 1607 | 1608 | 1609 | 1610 |
| ADI-55704 | 1702 | 1703 | 1704 | 1705 | 1706 | 1707 | 1708 | 1709 | 1710 |
| ADI-55705 | 1802 | 1803 | 1804 | 1805 | 1806 | 1807 | 1808 | 1809 | 1810 |
| ADI-55706 | 1902 | 1903 | 1904 | 1905 | 1906 | 1907 | 1908 | 1909 | 1910 |
| ADI-55707 | 2002 | 2003 | 2004 | 2005 | 2006 | 2007 | 2008 | 2009 | 2010 |
| ADI-55708 | 2102 | 2103 | 2104 | 2105 | 2106 | 2107 | 2108 | 2109 | 2110 |
| ADI-55709 | 2202 | 2203 | 2204 | 2205 | 2206 | 2207 | 2208 | 2209 | 2210 |
| ADI-55710 | 2302 | 2303 | 2304 | 2305 | 2306 | 2307 | 2308 | 2309 | 2310 |
| ADI-55711 | 2402 | 2403 | 2404 | 2405 | 2406 | 2407 | 2408 | 2409 | 2410 |
| ADI-55712 | 2502 | 2503 | 2504 | 2505 | 2506 | 2507 | 2508 | 2509 | 2510 |

FIG. 1A

| ADI ID | VH Protein SEQ ID NO: | VH FR1 Protein SEQ ID NO: | VH CDR1 Protein SEQ ID NO: | VH FR2 Protein SEQ ID NO: | VH CDR2 Protein SEQ ID NO: | VH FR3 Protein SEQ ID NO: | VH CDR3 Protein SEQ ID NO: | VH FR4 Protein SEQ ID NO: | VH DNA SEQ ID NO: |
|---|---|---|---|---|---|---|---|---|---|
| ADI-55713 | 2602 | 2603 | 2604 | 2605 | 2606 | 2607 | 2608 | 2609 | 2610 |
| ADI-55714 | 2702 | 2703 | 2704 | 2705 | 2706 | 2707 | 2708 | 2709 | 2710 |
| ADI-55715 | 2802 | 2803 | 2804 | 2805 | 2806 | 2807 | 2808 | 2809 | 2810 |
| ADI-55716 | 2902 | 2903 | 2904 | 2905 | 2906 | 2907 | 2908 | 2909 | 2910 |
| ADI-55717 | 3002 | 3003 | 3004 | 3005 | 3006 | 3007 | 3008 | 3009 | 3010 |
| ADI-55718 | 3102 | 3103 | 3104 | 3105 | 3106 | 3107 | 3108 | 3109 | 3110 |
| ADI-55719 | 3202 | 3203 | 3204 | 3205 | 3206 | 3207 | 3208 | 3209 | 3210 |
| ADI-55721 | 3302 | 3303 | 3304 | 3305 | 3306 | 3307 | 3308 | 3309 | 3310 |
| ADI-55722 | 3402 | 3403 | 3404 | 3405 | 3406 | 3407 | 3408 | 3409 | 3410 |
| ADI-55723 | 3502 | 3503 | 3504 | 3505 | 3506 | 3507 | 3508 | 3509 | 3510 |
| ADI-55724 | 3602 | 3603 | 3604 | 3605 | 3606 | 3607 | 3608 | 3609 | 3610 |
| ADI-55725 | 3702 | 3703 | 3704 | 3705 | 3706 | 3707 | 3708 | 3709 | 3710 |
| ADI-55726 | 3802 | 3803 | 3804 | 3805 | 3806 | 3807 | 3808 | 3809 | 3810 |
| ADI-55727 | 3902 | 3903 | 3904 | 3905 | 3906 | 3907 | 3908 | 3909 | 3910 |
| ADI-55728 | 4002 | 4003 | 4004 | 4005 | 4006 | 4007 | 4008 | 4009 | 4010 |
| ADI-55729 | 4102 | 4103 | 4104 | 4105 | 4106 | 4107 | 4108 | 4109 | 4110 |
| ADI-55730 | 4202 | 4203 | 4204 | 4205 | 4206 | 4207 | 4208 | 4209 | 4210 |
| ADI-55731 | 4302 | 4303 | 4304 | 4305 | 4306 | 4307 | 4308 | 4309 | 4310 |
| ADI-55732 | 4402 | 4403 | 4404 | 4405 | 4406 | 4407 | 4408 | 4409 | 4410 |
| ADI-55733 | 4502 | 4503 | 4504 | 4505 | 4506 | 4507 | 4508 | 4509 | 4510 |
| ADI-55734 | 4602 | 4603 | 4604 | 4605 | 4606 | 4607 | 4608 | 4609 | 4610 |
| ADI-55735 | 4702 | 4703 | 4704 | 4705 | 4706 | 4707 | 4708 | 4709 | 4710 |
| ADI-55736 | 4802 | 4803 | 4804 | 4805 | 4806 | 4807 | 4808 | 4809 | 4810 |
| ADI-55737 | 4902 | 4903 | 4904 | 4905 | 4906 | 4907 | 4908 | 4909 | 4910 |
| ADI-55738 | 5002 | 5003 | 5004 | 5005 | 5006 | 5007 | 5008 | 5009 | 5010 |

FIG. 1B

| ADI ID | VH Protein SEQ ID NO: | VH FR1 Protein SEQ ID NO: | VH CDR1 Protein SEQ ID NO: | VH FR2 Protein SEQ ID NO: | VH CDR2 Protein SEQ ID NO: | VH FR3 Protein SEQ ID NO: | VH CDR3 Protein SEQ ID NO: | VH FR4 Protein SEQ ID NO: | VH DNA SEQ ID NO: |
|---|---|---|---|---|---|---|---|---|---|
| ADI-55739 | 5102 | 5103 | 5104 | 5105 | 5106 | 5107 | 5108 | 5109 | 5110 |
| ADI-55740 | 5202 | 5203 | 5204 | 5205 | 5206 | 5207 | 5208 | 5209 | 5210 |
| ADI-55741 | 5302 | 5303 | 5304 | 5305 | 5306 | 5307 | 5308 | 5309 | 5310 |
| ADI-55742 | 5402 | 5403 | 5404 | 5405 | 5406 | 5407 | 5408 | 5409 | 5410 |
| ADI-55743 | 5502 | 5503 | 5504 | 5505 | 5506 | 5507 | 5508 | 5509 | 5510 |
| ADI-55744 | 5602 | 5603 | 5604 | 5605 | 5606 | 5607 | 5608 | 5609 | 5610 |
| ADI-55745 | 5702 | 5703 | 5704 | 5705 | 5706 | 5707 | 5708 | 5709 | 5710 |
| ADI-55746 | 5802 | 5803 | 5804 | 5805 | 5806 | 5807 | 5808 | 5809 | 5810 |
| ADI-55747 | 5902 | 5903 | 5904 | 5905 | 5906 | 5907 | 5908 | 5909 | 5910 |
| ADI-55748 | 6002 | 6003 | 6004 | 6005 | 6006 | 6007 | 6008 | 6009 | 6010 |
| ADI-55749 | 6102 | 6103 | 6104 | 6105 | 6106 | 6107 | 6108 | 6109 | 6110 |
| ADI-55750 | 6202 | 6203 | 6204 | 6205 | 6206 | 6207 | 6208 | 6209 | 6210 |
| ADI-55751 | 6302 | 6303 | 6304 | 6305 | 6306 | 6307 | 6308 | 6309 | 6310 |
| ADI-55752 | 6402 | 6403 | 6404 | 6405 | 6406 | 6407 | 6408 | 6409 | 6410 |
| ADI-55753 | 6502 | 6503 | 6504 | 6505 | 6506 | 6507 | 6508 | 6509 | 6510 |
| ADI-55754 | 6602 | 6603 | 6604 | 6605 | 6606 | 6607 | 6608 | 6609 | 6610 |
| ADI-55755 | 6702 | 6703 | 6704 | 6705 | 6706 | 6707 | 6708 | 6709 | 6710 |
| ADI-55756 | 6802 | 6803 | 6804 | 6805 | 6806 | 6807 | 6808 | 6809 | 6810 |
| ADI-55757 | 6902 | 6903 | 6904 | 6905 | 6906 | 6907 | 6908 | 6909 | 6910 |
| ADI-55758 | 7002 | 7003 | 7004 | 7005 | 7006 | 7007 | 7008 | 7009 | 7010 |
| ADI-55720 | 7102 | 7103 | 7104 | 7105 | 7106 | 7107 | 7108 | 7109 | 7110 |
| ADI-55760 | 7202 | 7203 | 7204 | 7205 | 7206 | 7207 | 7208 | 7209 | 7210 |
| ADI-55761 | 7302 | 7303 | 7304 | 7305 | 7306 | 7307 | 7308 | 7309 | 7310 |
| ADI-55762 | 7402 | 7403 | 7404 | 7405 | 7406 | 7407 | 7408 | 7409 | 7410 |
| ADI-55763 | 7502 | 7503 | 7504 | 7505 | 7506 | 7507 | 7508 | 7509 | 7510 |

FIG. 1C

| ADI ID | VH Protein SEQ ID NO: | VH FR1 Protein SEQ ID NO: | VH CDR1 Protein SEQ ID NO: | VH FR2 Protein SEQ ID NO: | VH CDR2 Protein SEQ ID NO: | VH FR3 Protein SEQ ID NO: | VH CDR3 Protein SEQ ID NO: | VH FR4 Protein SEQ ID NO: | VH DNA SEQ ID NO: |
|---|---|---|---|---|---|---|---|---|---|
| ADI-55765 | 7602 | 7603 | 7604 | 7605 | 7606 | 7607 | 7608 | 7609 | 7610 |
| ADI-55766 | 7702 | 7703 | 7704 | 7705 | 7706 | 7707 | 7708 | 7709 | 7710 |
| ADI-55767 | 7802 | 7803 | 7804 | 7805 | 7806 | 7807 | 7808 | 7809 | 7810 |
| ADI-55769 | 7902 | 7903 | 7904 | 7905 | 7906 | 7907 | 7908 | 7909 | 7910 |
| ADI-55770 | 8002 | 8003 | 8004 | 8005 | 8006 | 8007 | 8008 | 8009 | 8010 |
| ADI-55771 | 8102 | 8103 | 8104 | 8105 | 8106 | 8107 | 8108 | 8109 | 8110 |
| ADI-55775 | 8202 | 8203 | 8204 | 8205 | 8206 | 8207 | 8208 | 8209 | 8210 |
| ADI-55776 | 8302 | 8303 | 8304 | 8305 | 8306 | 8307 | 8308 | 8309 | 8310 |
| ADI-55777 | 8402 | 8403 | 8404 | 8405 | 8406 | 8407 | 8408 | 8409 | 8410 |
| ADI-55950 | 8502 | 8503 | 8504 | 8505 | 8506 | 8507 | 8508 | 8509 | 8510 |
| ADI-55951 | 8602 | 8603 | 8604 | 8605 | 8606 | 8607 | 8608 | 8609 | 8610 |
| ADI-55952 | 8702 | 8703 | 8704 | 8705 | 8706 | 8707 | 8708 | 8709 | 8710 |
| ADI-55953 | 8802 | 8803 | 8804 | 8805 | 8806 | 8807 | 8808 | 8809 | 8810 |
| ADI-55954 | 8902 | 8903 | 8904 | 8905 | 8906 | 8907 | 8908 | 8909 | 8910 |
| ADI-55955 | 9002 | 9003 | 9004 | 9005 | 9006 | 9007 | 9008 | 9009 | 9010 |
| ADI-55956 | 9102 | 9103 | 9104 | 9105 | 9106 | 9107 | 9108 | 9109 | 9110 |
| ADI-55957 | 9202 | 9203 | 9204 | 9205 | 9206 | 9207 | 9208 | 9209 | 9210 |
| ADI-55958 | 9302 | 9303 | 9304 | 9305 | 9306 | 9307 | 9308 | 9309 | 9310 |
| ADI-55959 | 9402 | 9403 | 9404 | 9405 | 9406 | 9407 | 9408 | 9409 | 9410 |
| ADI-55960 | 9502 | 9503 | 9504 | 9505 | 9506 | 9507 | 9508 | 9509 | 9510 |
| ADI-55961 | 9602 | 9603 | 9604 | 9605 | 9606 | 9607 | 9608 | 9609 | 9610 |
| ADI-55962 | 9702 | 9703 | 9704 | 9705 | 9706 | 9707 | 9708 | 9709 | 9710 |
| ADI-55963 | 9802 | 9803 | 9804 | 9805 | 9806 | 9807 | 9808 | 9809 | 9810 |
| ADI-55964 | 9902 | 9903 | 9904 | 9905 | 9906 | 9907 | 9908 | 9909 | 9910 |
| ADI-55965 | 10002 | 10003 | 10004 | 10005 | 10006 | 10007 | 10008 | 10009 | 10010 |

FIG. 1D

| AD ID | VH Protein SEQ ID NO. | VH FR1 Protein SEQ ID NO. | VH CDR1 Protein SEQ ID NO. | VH FR2 Protein SEQ ID NO. | VH CDR2 Protein SEQ ID NO. | VH FR3 Protein SEQ ID NO. | VH CDR3 Protein SEQ ID NO. | VH FR4 Protein SEQ ID NO. | VH DNA SEQ ID NO. |
|---|---|---|---|---|---|---|---|---|---|
| ADI-55966 | 10102 | 10103 | 10104 | 10105 | 10106 | 10107 | 10108 | 10109 | 10110 |
| ADI-55967 | 10202 | 10203 | 10204 | 10205 | 10206 | 10207 | 10208 | 10209 | 10210 |
| ADI-55968 | 10302 | 10303 | 10304 | 10305 | 10306 | 10307 | 10308 | 10309 | 10310 |
| ADI-55969 | 10402 | 10403 | 10404 | 10405 | 10406 | 10407 | 10408 | 10409 | 10410 |
| ADI-55970 | 10502 | 10503 | 10504 | 10505 | 10506 | 10507 | 10508 | 10509 | 10510 |
| ADI-55972 | 10602 | 10603 | 10604 | 10605 | 10606 | 10607 | 10608 | 10609 | 10610 |
| ADI-55973 | 10702 | 10703 | 10704 | 10705 | 10706 | 10707 | 10708 | 10709 | 10710 |
| ADI-55974 | 10802 | 10803 | 10804 | 10805 | 10806 | 10807 | 10808 | 10809 | 10810 |
| ADI-55975 | 10902 | 10903 | 10904 | 10905 | 10906 | 10907 | 10908 | 10909 | 10910 |
| ADI-55976 | 11002 | 11003 | 11004 | 11005 | 11006 | 11007 | 11008 | 11009 | 11010 |
| ADI-55977 | 11102 | 11103 | 11104 | 11105 | 11106 | 11107 | 11108 | 11109 | 11110 |
| ADI-55978 | 11202 | 11203 | 11204 | 11205 | 11206 | 11207 | 11208 | 11209 | 11210 |
| ADI-55979 | 11302 | 11303 | 11304 | 11305 | 11306 | 11307 | 11308 | 11309 | 11310 |
| ADI-55980 | 11402 | 11403 | 11404 | 11405 | 11406 | 11407 | 11408 | 11409 | 11410 |
| ADI-55981 | 11502 | 11503 | 11504 | 11505 | 11506 | 11507 | 11508 | 11509 | 11510 |
| ADI-55982 | 11602 | 11603 | 11604 | 11605 | 11606 | 11607 | 11608 | 11609 | 11610 |
| ADI-55984 | 11702 | 11703 | 11704 | 11705 | 11706 | 11707 | 11708 | 11709 | 11710 |
| ADI-55986 | 11802 | 11803 | 11804 | 11805 | 11806 | 11807 | 11808 | 11809 | 11810 |
| ADI-55988 | 11902 | 11903 | 11904 | 11905 | 11906 | 11907 | 11908 | 11909 | 11910 |
| ADI-55989 | 12002 | 12003 | 12004 | 12005 | 12006 | 12007 | 12008 | 12009 | 12010 |
| ADI-55990 | 12102 | 12103 | 12104 | 12105 | 12106 | 12107 | 12108 | 12109 | 12110 |
| ADI-55992 | 12202 | 12203 | 12204 | 12205 | 12206 | 12207 | 12208 | 12209 | 12210 |
| ADI-55993 | 12302 | 12303 | 12304 | 12305 | 12306 | 12307 | 12308 | 12309 | 12310 |
| ADI-55994 | 12402 | 12403 | 12404 | 12405 | 12406 | 12407 | 12408 | 12409 | 12410 |
| ADI-55995 | 12502 | 12503 | 12504 | 12505 | 12506 | 12507 | 12508 | 12509 | 12510 |

FIG. 1E

| AD ID | VH Protein SEQ ID NO. | VH FR1 Protein SEQ ID NO. | VH CDR1 Protein SEQ ID NO. | VH FR2 Protein SEQ ID NO. | VH CDR2 Protein SEQ ID NO. | VH FR3 Protein SEQ ID NO. | VH CDR3 Protein SEQ ID NO. | VH FR4 Protein SEQ ID NO. | VH DNA SEQ ID NO. |
|---|---|---|---|---|---|---|---|---|---|
| AD-55996 | 12602 | 12603 | 12604 | 12605 | 12606 | 12607 | 12608 | 12609 | 12610 |
| AD-55997 | 12702 | 12703 | 12704 | 12705 | 12706 | 12707 | 12708 | 12709 | 12710 |
| AD-55998 | 12802 | 12803 | 12804 | 12805 | 12806 | 12807 | 12808 | 12809 | 12810 |
| AD-55999 | 12902 | 12903 | 12904 | 12905 | 12906 | 12907 | 12908 | 12909 | 12910 |
| AD-56000 | 13002 | 13003 | 13004 | 13005 | 13006 | 13007 | 13008 | 13009 | 13010 |
| AD-56001 | 13102 | 13103 | 13104 | 13105 | 13106 | 13107 | 13108 | 13109 | 13110 |
| AD-56002 | 13202 | 13203 | 13204 | 13205 | 13206 | 13207 | 13208 | 13209 | 13210 |
| AD-56003 | 13302 | 13303 | 13304 | 13305 | 13306 | 13307 | 13308 | 13309 | 13310 |
| AD-56004 | 13402 | 13403 | 13404 | 13405 | 13406 | 13407 | 13408 | 13409 | 13410 |
| AD-56005 | 13502 | 13503 | 13504 | 13505 | 13506 | 13507 | 13508 | 13509 | 13510 |
| AD-56006 | 13602 | 13603 | 13604 | 13605 | 13606 | 13607 | 13608 | 13609 | 13610 |
| AD-56007 | 13702 | 13703 | 13704 | 13705 | 13706 | 13707 | 13708 | 13709 | 13710 |
| AD-56008 | 13802 | 13803 | 13804 | 13805 | 13806 | 13807 | 13808 | 13809 | 13810 |
| AD-56009 | 13902 | 13903 | 13904 | 13905 | 13906 | 13907 | 13908 | 13909 | 13910 |
| AD-56010 | 14002 | 14003 | 14004 | 14005 | 14006 | 14007 | 14008 | 14009 | 14010 |
| AD-56011 | 14102 | 14103 | 14104 | 14105 | 14106 | 14107 | 14108 | 14109 | 14110 |
| AD-56012 | 14202 | 14203 | 14204 | 14205 | 14206 | 14207 | 14208 | 14209 | 14210 |
| AD-56013 | 14302 | 14303 | 14304 | 14305 | 14306 | 14307 | 14308 | 14309 | 14310 |
| AD-56014 | 14402 | 14403 | 14404 | 14405 | 14406 | 14407 | 14408 | 14409 | 14410 |
| AD-56015 | 14502 | 14503 | 14504 | 14505 | 14506 | 14507 | 14508 | 14509 | 14510 |
| AD-56016 | 14602 | 14603 | 14604 | 14605 | 14606 | 14607 | 14608 | 14609 | 14610 |
| AD-56017 | 14702 | 14703 | 14704 | 14705 | 14706 | 14707 | 14708 | 14709 | 14710 |
| AD-56018 | 14802 | 14803 | 14804 | 14805 | 14806 | 14807 | 14808 | 14809 | 14810 |
| AD-56019 | 14902 | 14903 | 14904 | 14905 | 14906 | 14907 | 14908 | 14909 | 14910 |
| AD-56020 | 15002 | 15003 | 15004 | 15005 | 15006 | 15007 | 15008 | 15009 | 15010 |

FIG. 1F

| AD ID | VH Protein SEQ ID NO: | VH FR1 Protein SEQ ID NO: | VH CDR1 Protein SEQ ID NO: | VH FR2 Protein SEQ ID NO: | VH CDR2 Protein SEQ ID NO: | VH FR3 Protein SEQ ID NO: | VH CDR3 Protein SEQ ID NO: | VH FR4 Protein SEQ ID NO: | VH DNA SEQ ID NO: |
|---|---|---|---|---|---|---|---|---|---|
| ADI-56021 | 15102 | 15103 | 15104 | 15105 | 15106 | 15107 | 15108 | 15109 | 15110 |
| ADI-56022 | 15202 | 15203 | 15204 | 15205 | 15206 | 15207 | 15208 | 15209 | 15210 |
| ADI-56023 | 15302 | 15303 | 15304 | 15305 | 15306 | 15307 | 15308 | 15309 | 15310 |
| ADI-56024 | 15402 | 15403 | 15404 | 15405 | 15406 | 15407 | 15408 | 15409 | 15410 |
| ADI-56025 | 15502 | 15503 | 15504 | 15505 | 15506 | 15507 | 15508 | 15509 | 15510 |
| ADI-56026 | 15602 | 15603 | 15604 | 15605 | 15606 | 15607 | 15608 | 15609 | 15610 |
| ADI-56027 | 15702 | 15703 | 15704 | 15705 | 15706 | 15707 | 15708 | 15709 | 15710 |
| ADI-56028 | 15802 | 15803 | 15804 | 15805 | 15806 | 15807 | 15808 | 15809 | 15810 |
| ADI-56029 | 15902 | 15903 | 15904 | 15905 | 15906 | 15907 | 15908 | 15909 | 15910 |
| ADI-56030 | 16002 | 16003 | 16004 | 16005 | 16006 | 16007 | 16008 | 16009 | 16010 |
| ADI-56031 | 16102 | 16103 | 16104 | 16105 | 16106 | 16107 | 16108 | 16109 | 16110 |
| ADI-56032 | 16202 | 16203 | 16204 | 16205 | 16206 | 16207 | 16208 | 16209 | 16210 |
| ADI-56033 | 16302 | 16303 | 16304 | 16305 | 16306 | 16307 | 16308 | 16309 | 16310 |
| ADI-56034 | 16402 | 16403 | 16404 | 16405 | 16406 | 16407 | 16408 | 16409 | 16410 |
| ADI-56035 | 16502 | 16503 | 16504 | 16505 | 16506 | 16507 | 16508 | 16509 | 16510 |
| ADI-56037 | 16602 | 16603 | 16604 | 16605 | 16606 | 16607 | 16608 | 16609 | 16610 |
| ADI-56038 | 16702 | 16703 | 16704 | 16705 | 16706 | 16707 | 16708 | 16709 | 16710 |
| ADI-56039 | 16802 | 16803 | 16804 | 16805 | 16806 | 16807 | 16808 | 16809 | 16810 |
| ADI-56040 | 16902 | 16903 | 16904 | 16905 | 16906 | 16907 | 16908 | 16909 | 16910 |
| ADI-56041 | 17002 | 17003 | 17004 | 17005 | 17006 | 17007 | 17008 | 17009 | 17010 |
| ADI-56042 | 17102 | 17103 | 17104 | 17105 | 17106 | 17107 | 17108 | 17109 | 17110 |
| ADI-56043 | 17202 | 17203 | 17204 | 17205 | 17206 | 17207 | 17208 | 17209 | 17210 |
| ADI-56044 | 17302 | 17303 | 17304 | 17305 | 17306 | 17307 | 17308 | 17309 | 17310 |
| ADI-56045 | 17402 | 17403 | 17404 | 17405 | 17406 | 17407 | 17408 | 17409 | 17410 |
| ADI-56046 | 17502 | 17503 | 17504 | 17505 | 17506 | 17507 | 17508 | 17509 | 17510 |

FIG. 1G

| AD ID | VH Protein SEQ ID NO: | VH FR1 Protein SEQ ID NO: | VH CDR1 Protein SEQ ID NO: | VH FR2 Protein SEQ ID NO: | VH CDR2 Protein SEQ ID NO: | VH FR3 Protein SEQ ID NO: | VH CDR3 Protein SEQ ID NO: | VH FR4 Protein SEQ ID NO: | VH DNA SEQ ID NO: |
|---|---|---|---|---|---|---|---|---|---|
| ADI-56047 | 17602 | 17603 | 17604 | 17605 | 17606 | 17607 | 17608 | 17609 | 17610 |
| ADI-56048 | 17702 | 17703 | 17704 | 17705 | 17706 | 17707 | 17708 | 17709 | 17710 |
| ADI-56049 | 17802 | 17803 | 17804 | 17805 | 17806 | 17807 | 17808 | 17809 | 17810 |
| ADI-56050 | 17902 | 17903 | 17904 | 17905 | 17906 | 17907 | 17908 | 17909 | 17910 |
| ADI-56051 | 18002 | 18003 | 18004 | 18005 | 18006 | 18007 | 18008 | 18009 | 18010 |
| ADI-56052 | 18102 | 18103 | 18104 | 18105 | 18106 | 18107 | 18108 | 18109 | 18110 |
| ADI-56053 | 18202 | 18203 | 18204 | 18205 | 18206 | 18207 | 18208 | 18209 | 18210 |
| ADI-56054 | 18302 | 18303 | 18304 | 18305 | 18306 | 18307 | 18308 | 18309 | 18310 |
| ADI-56055 | 18402 | 18403 | 18404 | 18405 | 18406 | 18407 | 18408 | 18409 | 18410 |
| ADI-56056 | 18502 | 18503 | 18504 | 18505 | 18506 | 18507 | 18508 | 18509 | 18510 |
| ADI-56057 | 18602 | 18603 | 18604 | 18605 | 18606 | 18607 | 18608 | 18609 | 18610 |
| ADI-56058 | 18702 | 18703 | 18704 | 18705 | 18706 | 18707 | 18708 | 18709 | 18710 |
| ADI-56059 | 18802 | 18803 | 18804 | 18805 | 18806 | 18807 | 18808 | 18809 | 18810 |
| ADI-56061 | 18902 | 18903 | 18904 | 18905 | 18906 | 18907 | 18908 | 18909 | 18910 |
| ADI-56062 | 19002 | 19003 | 19004 | 19005 | 19006 | 19007 | 19008 | 19009 | 19010 |
| ADI-56063 | 19102 | 19103 | 19104 | 19105 | 19106 | 19107 | 19108 | 19109 | 19110 |
| ADI-56064 | 19202 | 19203 | 19204 | 19205 | 19206 | 19207 | 19208 | 19209 | 19210 |
| ADI-56065 | 19302 | 19303 | 19304 | 19305 | 19306 | 19307 | 19308 | 19309 | 19310 |
| ADI-56066 | 19402 | 19403 | 19404 | 19405 | 19406 | 19407 | 19408 | 19409 | 19410 |
| ADI-56067 | 19502 | 19503 | 19504 | 19505 | 19506 | 19507 | 19508 | 19509 | 19510 |
| ADI-56068 | 19602 | 19603 | 19604 | 19605 | 19606 | 19607 | 19608 | 19609 | 19610 |
| ADI-56069 | 19702 | 19703 | 19704 | 19705 | 19706 | 19707 | 19708 | 19709 | 19710 |
| ADI-56070 | 19802 | 19803 | 19804 | 19805 | 19806 | 19807 | 19808 | 19809 | 19810 |
| ADI-56071 | 19902 | 19903 | 19904 | 19905 | 19906 | 19907 | 19908 | 19909 | 19910 |
| ADI-56072 | 20002 | 20003 | 20004 | 20005 | 20006 | 20007 | 20008 | 20009 | 20010 |

FIG. 1H

| ADI ID | VH Protein SEQ ID NO: | VH FR1 Protein SEQ ID NO: | VH CDR1 Protein SEQ ID NO: | VH FR2 Protein SEQ ID NO: | VH CDR2 Protein SEQ ID NO: | VH FR3 Protein SEQ ID NO: | VH CDR3 Protein SEQ ID NO: | VH FR4 Protein SEQ ID NO: | VH DNA SEQ ID NO: |
|---|---|---|---|---|---|---|---|---|---|
| ADI-56073 | 20102 | 20103 | 20104 | 20105 | 20106 | 20107 | 20108 | 20109 | 20110 |
| ADI-56074 | 20202 | 20203 | 20204 | 20205 | 20206 | 20207 | 20208 | 20209 | 20210 |
| ADI-56075 | 20302 | 20303 | 20304 | 20305 | 20306 | 20307 | 20308 | 20309 | 20310 |
| ADI-56076 | 20402 | 20403 | 20404 | 20405 | 20406 | 20407 | 20408 | 20409 | 20410 |
| ADI-56078 | 20502 | 20503 | 20504 | 20505 | 20506 | 20507 | 20508 | 20509 | 20510 |
| ADI-56079 | 20602 | 20603 | 20604 | 20605 | 20606 | 20607 | 20608 | 20609 | 20610 |
| ADI-56080 | 20702 | 20703 | 20704 | 20705 | 20706 | 20707 | 20708 | 20709 | 20710 |
| ADI-56081 | 20802 | 20803 | 20804 | 20805 | 20806 | 20807 | 20808 | 20809 | 20810 |
| ADI-56082 | 20902 | 20903 | 20904 | 20905 | 20906 | 20907 | 20908 | 20909 | 20910 |
| ADI-56083 | 21002 | 21003 | 21004 | 21005 | 21006 | 21007 | 21008 | 21009 | 21010 |
| ADI-56084 | 21102 | 21103 | 21104 | 21105 | 21106 | 21107 | 21108 | 21109 | 21110 |

FIG. 1I

| AD ID | VL Protein SEQ ID NO: | VL FR1 Protein SEQ ID NO: | VL CDR1 Protein SEQ ID NO: | VL FR2 Protein SEQ ID NO: | VL CDR2 Protein SEQ ID NO: | VL FR3 Protein SEQ ID NO: | VL CDR3 Protein SEQ ID NO: | VL FR4 Protein SEQ ID NO: | VL DNA SEQ ID NO: |
|---|---|---|---|---|---|---|---|---|---|
| ADI-55688 | 112 | 113 | 114 | 115 | 116 | 117 | 118 | 119 | 120 |
| ADI-55689 | 212 | 213 | 214 | 215 | 216 | 217 | 218 | 219 | 220 |
| ADI-55690 | 312 | 313 | 314 | 315 | 316 | 317 | 318 | 319 | 320 |
| ADI-55691 | 412 | 413 | 414 | 415 | 416 | 417 | 418 | 419 | 420 |
| ADI-55692 | 512 | 513 | 514 | 515 | 516 | 517 | 518 | 519 | 520 |
| ADI-55693 | 612 | 613 | 614 | 615 | 616 | 617 | 618 | 619 | 620 |
| ADI-55694 | 712 | 713 | 714 | 715 | 716 | 717 | 718 | 719 | 720 |
| ADI-55695 | 812 | 813 | 814 | 815 | 816 | 817 | 818 | 819 | 820 |
| ADI-55696 | 912 | 913 | 914 | 915 | 916 | 917 | 918 | 919 | 920 |
| ADI-55697 | 1012 | 1013 | 1014 | 1015 | 1016 | 1017 | 1018 | 1019 | 1020 |
| ADI-55698 | 1112 | 1113 | 1114 | 1115 | 1116 | 1117 | 1118 | 1119 | 1120 |
| ADI-55699 | 1212 | 1213 | 1214 | 1215 | 1216 | 1217 | 1218 | 1219 | 1220 |
| ADI-55700 | 1312 | 1313 | 1314 | 1315 | 1316 | 1317 | 1318 | 1319 | 1320 |
| ADI-55701 | 1412 | 1413 | 1414 | 1415 | 1416 | 1417 | 1418 | 1419 | 1420 |
| ADI-55702 | 1512 | 1513 | 1514 | 1515 | 1516 | 1517 | 1518 | 1519 | 1520 |
| ADI-55703 | 1612 | 1613 | 1614 | 1615 | 1616 | 1617 | 1618 | 1619 | 1620 |
| ADI-55704 | 1712 | 1713 | 1714 | 1715 | 1716 | 1717 | 1718 | 1719 | 1720 |
| ADI-55705 | 1812 | 1813 | 1814 | 1815 | 1816 | 1817 | 1818 | 1819 | 1820 |
| ADI-55706 | 1912 | 1913 | 1914 | 1915 | 1916 | 1917 | 1918 | 1919 | 1920 |
| ADI-55707 | 2012 | 2013 | 2014 | 2015 | 2016 | 2017 | 2018 | 2019 | 2020 |
| ADI-55708 | 2112 | 2113 | 2114 | 2115 | 2116 | 2117 | 2118 | 2119 | 2120 |
| ADI-55709 | 2212 | 2213 | 2214 | 2215 | 2216 | 2217 | 2218 | 2219 | 2220 |
| ADI-55710 | 2312 | 2313 | 2314 | 2315 | 2316 | 2317 | 2318 | 2319 | 2320 |
| ADI-55711 | 2412 | 2413 | 2414 | 2415 | 2416 | 2417 | 2418 | 2419 | 2420 |
| ADI-55712 | 2512 | 2513 | 2514 | 2515 | 2516 | 2517 | 2518 | 2519 | 2520 |

FIG. 2A

| AD ID | VL Protein SEQ ID NO: | VL FR1 Protein SEQ ID NO: | VL CDR1 Protein SEQ ID NO: | VL FR2 Protein SEQ ID NO: | VL CDR2 Protein SEQ ID NO: | VL FR3 Protein SEQ ID NO: | VL CDR3 Protein SEQ ID NO: | VL FR4 Protein SEQ ID NO: | VL DNA SEQ ID NO: |
|---|---|---|---|---|---|---|---|---|---|
| ADI-55713 | 2612 | 2613 | 2614 | 2615 | 2616 | 2617 | 2618 | 2619 | 2620 |
| ADI-55714 | 2712 | 2713 | 2714 | 2715 | 2716 | 2717 | 2718 | 2719 | 2720 |
| ADI-55715 | 2812 | 2813 | 2814 | 2815 | 2816 | 2817 | 2818 | 2819 | 2820 |
| ADI-55716 | 2912 | 2913 | 2914 | 2915 | 2916 | 2917 | 2918 | 2919 | 2920 |
| ADI-55717 | 3012 | 3013 | 3014 | 3015 | 3016 | 3017 | 3018 | 3019 | 3020 |
| ADI-55718 | 3112 | 3113 | 3114 | 3115 | 3116 | 3117 | 3118 | 3119 | 3120 |
| ADI-55719 | 3212 | 3213 | 3214 | 3215 | 3216 | 3217 | 3218 | 3219 | 3220 |
| ADI-55721 | 3312 | 3313 | 3314 | 3315 | 3316 | 3317 | 3318 | 3319 | 3320 |
| ADI-55722 | 3412 | 3413 | 3414 | 3415 | 3416 | 3417 | 3418 | 3419 | 3420 |
| ADI-55723 | 3512 | 3513 | 3514 | 3515 | 3516 | 3517 | 3518 | 3519 | 3520 |
| ADI-55724 | 3612 | 3613 | 3614 | 3615 | 3616 | 3617 | 3618 | 3619 | 3620 |
| ADI-55725 | 3712 | 3713 | 3714 | 3715 | 3716 | 3717 | 3718 | 3719 | 3720 |
| ADI-55726 | 3812 | 3813 | 3814 | 3815 | 3816 | 3817 | 3818 | 3819 | 3820 |
| ADI-55727 | 3912 | 3913 | 3914 | 3915 | 3916 | 3917 | 3918 | 3919 | 3920 |
| ADI-55728 | 4012 | 4013 | 4014 | 4015 | 4016 | 4017 | 4018 | 4019 | 4020 |
| ADI-55729 | 4112 | 4113 | 4114 | 4115 | 4116 | 4117 | 4118 | 4119 | 4120 |
| ADI-55730 | 4212 | 4213 | 4214 | 4215 | 4216 | 4217 | 4218 | 4219 | 4220 |
| ADI-55731 | 4312 | 4313 | 4314 | 4315 | 4316 | 4317 | 4318 | 4319 | 4320 |
| ADI-55732 | 4412 | 4413 | 4414 | 4415 | 4416 | 4417 | 4418 | 4419 | 4420 |
| ADI-55733 | 4512 | 4513 | 4514 | 4515 | 4516 | 4517 | 4518 | 4519 | 4520 |
| ADI-55734 | 4612 | 4613 | 4614 | 4615 | 4616 | 4617 | 4618 | 4619 | 4620 |
| ADI-55735 | 4712 | 4713 | 4714 | 4715 | 4716 | 4717 | 4718 | 4719 | 4720 |
| ADI-55736 | 4812 | 4813 | 4814 | 4815 | 4816 | 4817 | 4818 | 4819 | 4820 |
| ADI-55737 | 4912 | 4913 | 4914 | 4915 | 4916 | 4917 | 4918 | 4919 | 4920 |
| ADI-55738 | 5012 | 5013 | 5014 | 5015 | 5016 | 5017 | 5018 | 5019 | 5020 |

FIG. 2B

| ADI ID | VL Protein SEQ ID NO: | VL FR1 Protein SEQ ID NO: | VL CDR1 Protein SEQ ID NO: | VL FR2 Protein SEQ ID NO: | VL CDR2 Protein SEQ ID NO: | VL FR3 Protein SEQ ID NO: | VL CDR3 Protein SEQ ID NO: | VL FR4 Protein SEQ ID NO: | VL DNA SEQ ID NO: |
|---|---|---|---|---|---|---|---|---|---|
| ADI-55739 | 5112 | 5113 | 5114 | 5115 | 5116 | 5117 | 5118 | 5119 | 5120 |
| ADI-55740 | 5212 | 5213 | 5214 | 5215 | 5216 | 5217 | 5218 | 5219 | 5220 |
| ADI-55741 | 5312 | 5313 | 5314 | 5315 | 5316 | 5317 | 5318 | 5319 | 5320 |
| ADI-55742 | 5412 | 5413 | 5414 | 5415 | 5416 | 5417 | 5418 | 5419 | 5420 |
| ADI-55743 | 5512 | 5513 | 5514 | 5515 | 5516 | 5517 | 5518 | 5519 | 5520 |
| ADI-55744 | 5612 | 5613 | 5614 | 5615 | 5616 | 5617 | 5618 | 5619 | 5620 |
| ADI-55745 | 5712 | 5713 | 5714 | 5715 | 5716 | 5717 | 5718 | 5719 | 5720 |
| ADI-55746 | 5812 | 5813 | 5814 | 5815 | 5816 | 5817 | 5818 | 5819 | 5820 |
| ADI-55747 | 5912 | 5913 | 5914 | 5915 | 5916 | 5917 | 5918 | 5919 | 5920 |
| ADI-55748 | 6012 | 6013 | 6014 | 6015 | 6016 | 6017 | 6018 | 6019 | 6020 |
| ADI-55749 | 6112 | 6113 | 6114 | 6115 | 6116 | 6117 | 6118 | 6119 | 6120 |
| ADI-55750 | 6212 | 6213 | 6214 | 6215 | 6216 | 6217 | 6218 | 6219 | 6220 |
| ADI-55751 | 6312 | 6313 | 6314 | 6315 | 6316 | 6317 | 6318 | 6319 | 6320 |
| ADI-55752 | 6412 | 6413 | 6414 | 6415 | 6416 | 6417 | 6418 | 6419 | 6420 |
| ADI-55753 | 6512 | 6513 | 6514 | 6515 | 6516 | 6517 | 6518 | 6519 | 6520 |
| ADI-55754 | 6612 | 6613 | 6614 | 6615 | 6616 | 6617 | 6618 | 6619 | 6620 |
| ADI-55755 | 6712 | 6713 | 6714 | 6715 | 6716 | 6717 | 6718 | 6719 | 6720 |
| ADI-55756 | 6812 | 6813 | 6814 | 6815 | 6816 | 6817 | 6818 | 6819 | 6820 |
| ADI-55757 | 6912 | 6913 | 6914 | 6915 | 6916 | 6917 | 6918 | 6919 | 6920 |
| ADI-55758 | 7012 | 7013 | 7014 | 7015 | 7016 | 7017 | 7018 | 7019 | 7020 |
| ADI-55720 | 7112 | 7113 | 7114 | 7115 | 7116 | 7117 | 7118 | 7119 | 7120 |
| ADI-55760 | 7212 | 7213 | 7214 | 7215 | 7216 | 7217 | 7218 | 7219 | 7220 |
| ADI-55761 | 7312 | 7313 | 7314 | 7315 | 7316 | 7317 | 7318 | 7319 | 7320 |
| ADI-55762 | 7412 | 7413 | 7414 | 7415 | 7416 | 7417 | 7418 | 7419 | 7420 |
| ADI-55763 | 7512 | 7513 | 7514 | 7515 | 7516 | 7517 | 7518 | 7519 | 7520 |

FIG. 2C

| ADI ID | VL Protein SEQ ID NO: | VL FR1 Protein SEQ ID NO: | VL CDR1 Protein SEQ ID NO: | VL FR2 Protein SEQ ID NO: | VL CDR2 Protein SEQ ID NO: | VL FR3 Protein SEQ ID NO: | VL CDR3 Protein SEQ ID NO: | VL FR4 Protein SEQ ID NO: | VL DNA SEQ ID NO: |
|---|---|---|---|---|---|---|---|---|---|
| ADI-55765 | 7612 | 7613 | 7614 | 7615 | 7616 | 7617 | 7618 | 7619 | 7620 |
| ADI-55766 | 7712 | 7713 | 7714 | 7715 | 7716 | 7717 | 7718 | 7719 | 7720 |
| ADI-55767 | 7812 | 7813 | 7814 | 7815 | 7816 | 7817 | 7818 | 7819 | 7820 |
| ADI-55769 | 7912 | 7913 | 7914 | 7915 | 7916 | 7917 | 7918 | 7919 | 7920 |
| ADI-55770 | 8012 | 8013 | 8014 | 8015 | 8016 | 8017 | 8018 | 8019 | 8020 |
| ADI-55771 | 8112 | 8113 | 8114 | 8115 | 8116 | 8117 | 8118 | 8119 | 8120 |
| ADI-55775 | 8212 | 8213 | 8214 | 8215 | 8216 | 8217 | 8218 | 8219 | 8220 |
| ADI-55776 | 8312 | 8313 | 8314 | 8315 | 8316 | 8317 | 8318 | 8319 | 8320 |
| ADI-55777 | 8412 | 8413 | 8414 | 8415 | 8416 | 8417 | 8418 | 8419 | 8420 |
| ADI-55950 | 8512 | 8513 | 8514 | 8515 | 8516 | 8517 | 8518 | 8519 | 8520 |
| ADI-55951 | 8612 | 8613 | 8614 | 8615 | 8616 | 8617 | 8618 | 8619 | 8620 |
| ADI-55952 | 8712 | 8713 | 8714 | 8715 | 8716 | 8717 | 8718 | 8719 | 8720 |
| ADI-55953 | 8812 | 8813 | 8814 | 8815 | 8816 | 8817 | 8818 | 8819 | 8820 |
| ADI-55954 | 8912 | 8913 | 8914 | 8915 | 8916 | 8917 | 8918 | 8919 | 8920 |
| ADI-55955 | 9012 | 9013 | 9014 | 9015 | 9016 | 9017 | 9018 | 9019 | 9020 |
| ADI-55956 | 9112 | 9113 | 9114 | 9115 | 9116 | 9117 | 9118 | 9119 | 9120 |
| ADI-55957 | 9212 | 9213 | 9214 | 9215 | 9216 | 9217 | 9218 | 9219 | 9220 |
| ADI-55958 | 9312 | 9313 | 9314 | 9315 | 9316 | 9317 | 9318 | 9319 | 9320 |
| ADI-55959 | 9412 | 9413 | 9414 | 9415 | 9416 | 9417 | 9418 | 9419 | 9420 |
| ADI-55960 | 9512 | 9513 | 9514 | 9515 | 9516 | 9517 | 9518 | 9519 | 9520 |
| ADI-55961 | 9612 | 9613 | 9614 | 9615 | 9616 | 9617 | 9618 | 9619 | 9620 |
| ADI-55962 | 9712 | 9713 | 9714 | 9715 | 9716 | 9717 | 9718 | 9719 | 9720 |
| ADI-55963 | 9812 | 9813 | 9814 | 9815 | 9816 | 9817 | 9818 | 9819 | 9820 |
| ADI-55964 | 9912 | 9913 | 9914 | 9915 | 9916 | 9917 | 9918 | 9919 | 9920 |
| ADI-55965 | 10012 | 10013 | 10014 | 10015 | 10016 | 10017 | 10018 | 10019 | 10020 |

FIG. 2D

| ADI ID | VL Protein SEQ ID NO: | VL FR1 Protein SEQ ID NO: | VL CDR1 Protein SEQ ID NO: | VL FR2 Protein SEQ ID NO: | VL CDR2 Protein SEQ ID NO: | VL FR3 Protein SEQ ID NO: | VL CDR3 Protein SEQ ID NO: | VL FR4 Protein SEQ ID NO: | VL DNA SEQ ID NO: |
|---|---|---|---|---|---|---|---|---|---|
| ADI-55966 | 10112 | 10113 | 10114 | 10115 | 10116 | 10117 | 10118 | 10119 | 10120 |
| ADI-55967 | 10212 | 10213 | 10214 | 10215 | 10216 | 10217 | 10218 | 10219 | 10220 |
| ADI-55968 | 10312 | 10313 | 10314 | 10315 | 10316 | 10317 | 10318 | 10319 | 10320 |
| ADI-55969 | 10412 | 10413 | 10414 | 10415 | 10416 | 10417 | 10418 | 10419 | 10420 |
| ADI-55970 | 10512 | 10513 | 10514 | 10515 | 10516 | 10517 | 10518 | 10519 | 10520 |
| ADI-55972 | 10612 | 10613 | 10614 | 10615 | 10616 | 10617 | 10618 | 10619 | 10620 |
| ADI-55973 | 10712 | 10713 | 10714 | 10715 | 10716 | 10717 | 10718 | 10719 | 10720 |
| ADI-55974 | 10812 | 10813 | 10814 | 10815 | 10816 | 10817 | 10818 | 10819 | 10820 |
| ADI-55975 | 10912 | 10913 | 10914 | 10915 | 10916 | 10917 | 10918 | 10919 | 10920 |
| ADI-55976 | 11012 | 11013 | 11014 | 11015 | 11016 | 11017 | 11018 | 11019 | 11020 |
| ADI-55977 | 11112 | 11113 | 11114 | 11115 | 11116 | 11117 | 11118 | 11119 | 11120 |
| ADI-55978 | 11212 | 11213 | 11214 | 11215 | 11216 | 11217 | 11218 | 11219 | 11220 |
| ADI-55979 | 11312 | 11313 | 11314 | 11315 | 11316 | 11317 | 11318 | 11319 | 11320 |
| ADI-55980 | 11412 | 11413 | 11414 | 11415 | 11416 | 11417 | 11418 | 11419 | 11420 |
| ADI-55981 | 11512 | 11513 | 11514 | 11515 | 11516 | 11517 | 11518 | 11519 | 11520 |
| ADI-55982 | 11612 | 11613 | 11614 | 11615 | 11616 | 11617 | 11618 | 11619 | 11620 |
| ADI-55984 | 11712 | 11713 | 11714 | 11715 | 11716 | 11717 | 11718 | 11719 | 11720 |
| ADI-55986 | 11812 | 11813 | 11814 | 11815 | 11816 | 11817 | 11818 | 11819 | 11820 |
| ADI-55988 | 11912 | 11913 | 11914 | 11915 | 11916 | 11917 | 11918 | 11919 | 11920 |
| ADI-55989 | 12012 | 12013 | 12014 | 12015 | 12016 | 12017 | 12018 | 12019 | 12020 |
| ADI-55990 | 12112 | 12113 | 12114 | 12115 | 12116 | 12117 | 12118 | 12119 | 12120 |
| ADI-55992 | 12212 | 12213 | 12214 | 12215 | 12216 | 12217 | 12218 | 12219 | 12220 |
| ADI-55993 | 12312 | 12313 | 12314 | 12315 | 12316 | 12317 | 12318 | 12319 | 12320 |
| ADI-55994 | 12412 | 12413 | 12414 | 12415 | 12416 | 12417 | 12418 | 12419 | 12420 |
| ADI-55995 | 12512 | 12513 | 12514 | 12515 | 12516 | 12517 | 12518 | 12519 | 12520 |

FIG. 2E

| ADI ID | VL Protein SEQ ID NO: | VL FR1 Protein SEQ ID NO: | VL CDR1 Protein SEQ ID NO: | VL FR2 Protein SEQ ID NO: | VL CDR2 Protein SEQ ID NO: | VL FR3 Protein SEQ ID NO: | VL CDR3 Protein SEQ ID NO: | VL FR4 Protein SEQ ID NO: | VL DNA SEQ ID NO: |
|---|---|---|---|---|---|---|---|---|---|
| ADI-55996 | 12612 | 12613 | 12614 | 12615 | 12616 | 12617 | 12618 | 12619 | 12620 |
| ADI-55997 | 12712 | 12713 | 12714 | 12715 | 12716 | 12717 | 12718 | 12719 | 12720 |
| ADI-55998 | 12812 | 12813 | 12814 | 12815 | 12816 | 12817 | 12818 | 12819 | 12820 |
| ADI-55999 | 12912 | 12913 | 12914 | 12915 | 12916 | 12917 | 12918 | 12919 | 12920 |
| ADI-56000 | 13012 | 13013 | 13014 | 13015 | 13016 | 13017 | 13018 | 13019 | 13020 |
| ADI-56001 | 13112 | 13113 | 13114 | 13115 | 13116 | 13117 | 13118 | 13119 | 13120 |
| ADI-56002 | 13212 | 13213 | 13214 | 13215 | 13216 | 13217 | 13218 | 13219 | 13220 |
| ADI-56003 | 13312 | 13313 | 13314 | 13315 | 13316 | 13317 | 13318 | 13319 | 13320 |
| ADI-56004 | 13412 | 13413 | 13414 | 13415 | 13416 | 13417 | 13418 | 13419 | 13420 |
| ADI-56005 | 13512 | 13513 | 13514 | 13515 | 13516 | 13517 | 13518 | 13519 | 13520 |
| ADI-56006 | 13612 | 13613 | 13614 | 13615 | 13616 | 13617 | 13618 | 13619 | 13620 |
| ADI-56007 | 13712 | 13713 | 13714 | 13715 | 13716 | 13717 | 13718 | 13719 | 13720 |
| ADI-56008 | 13812 | 13813 | 13814 | 13815 | 13816 | 13817 | 13818 | 13819 | 13820 |
| ADI-56009 | 13912 | 13913 | 13914 | 13915 | 13916 | 13917 | 13918 | 13919 | 13920 |
| ADI-56010 | 14012 | 14013 | 14014 | 14015 | 14016 | 14017 | 14018 | 14019 | 14020 |
| ADI-56011 | 14112 | 14113 | 14114 | 14115 | 14116 | 14117 | 14118 | 14119 | 14120 |
| ADI-56012 | 14212 | 14213 | 14214 | 14215 | 14216 | 14217 | 14218 | 14219 | 14220 |
| ADI-56013 | 14312 | 14313 | 14314 | 14315 | 14316 | 14317 | 14318 | 14319 | 14320 |
| ADI-56014 | 14412 | 14413 | 14414 | 14415 | 14416 | 14417 | 14418 | 14419 | 14420 |
| ADI-56015 | 14512 | 14513 | 14514 | 14515 | 14516 | 14517 | 14518 | 14519 | 14520 |
| ADI-56016 | 14612 | 14613 | 14614 | 14615 | 14616 | 14617 | 14618 | 14619 | 14620 |
| ADI-56017 | 14712 | 14713 | 14714 | 14715 | 14716 | 14717 | 14718 | 14719 | 14720 |
| ADI-56018 | 14812 | 14813 | 14814 | 14815 | 14816 | 14817 | 14818 | 14819 | 14820 |
| ADI-56019 | 14912 | 14913 | 14914 | 14915 | 14916 | 14917 | 14918 | 14919 | 14920 |
| ADI-56020 | 15012 | 15013 | 15014 | 15015 | 15016 | 15017 | 15018 | 15019 | 15020 |

FIG. 2F

| ADI ID | VL Protein SEQ ID NO: | VL FR1 Protein SEQ ID NO: | VL CDR1 Protein SEQ ID NO: | VL FR2 Protein SEQ ID NO: | VL CDR2 Protein SEQ ID NO: | VL FR3 Protein SEQ ID NO: | VL CDR3 Protein SEQ ID NO: | VL FR4 Protein SEQ ID NO: | VL DNA SEQ ID NO: |
|---|---|---|---|---|---|---|---|---|---|
| ADI-56021 | 15112 | 15113 | 15114 | 15115 | 15116 | 15117 | 15118 | 15119 | 15120 |
| ADI-56022 | 15212 | 15213 | 15214 | 15215 | 15216 | 15217 | 15218 | 15219 | 15220 |
| ADI-56023 | 15312 | 15313 | 15314 | 15315 | 15316 | 15317 | 15318 | 15319 | 15320 |
| ADI-56024 | 15412 | 15413 | 15414 | 15415 | 15416 | 15417 | 15418 | 15419 | 15420 |
| ADI-56025 | 15512 | 15513 | 15514 | 15515 | 15516 | 15517 | 15518 | 15519 | 15520 |
| ADI-56026 | 15612 | 15613 | 15614 | 15615 | 15616 | 15617 | 15618 | 15619 | 15620 |
| ADI-56027 | 15712 | 15713 | 15714 | 15715 | 15716 | 15717 | 15718 | 15719 | 15720 |
| ADI-56028 | 15812 | 15813 | 15814 | 15815 | 15816 | 15817 | 15818 | 15819 | 15820 |
| ADI-56029 | 15912 | 15913 | 15914 | 15915 | 15916 | 15917 | 15918 | 15919 | 15920 |
| ADI-56030 | 16012 | 16013 | 16014 | 16015 | 16016 | 16017 | 16018 | 16019 | 16020 |
| ADI-56031 | 16112 | 16113 | 16114 | 16115 | 16116 | 16117 | 16118 | 16119 | 16120 |
| ADI-56032 | 16212 | 16213 | 16214 | 16215 | 16216 | 16217 | 16218 | 16219 | 16220 |
| ADI-56033 | 16312 | 16313 | 16314 | 16315 | 16316 | 16317 | 16318 | 16319 | 16320 |
| ADI-56034 | 16412 | 16413 | 16414 | 16415 | 16416 | 16417 | 16418 | 16419 | 16420 |
| ADI-56035 | 16512 | 16513 | 16514 | 16515 | 16516 | 16517 | 16518 | 16519 | 16520 |
| ADI-56037 | 16612 | 16613 | 16614 | 16615 | 16616 | 16617 | 16618 | 16619 | 16620 |
| ADI-56038 | 16712 | 16713 | 16714 | 16715 | 16716 | 16717 | 16718 | 16719 | 16720 |
| ADI-56039 | 16812 | 16813 | 16814 | 16815 | 16816 | 16817 | 16818 | 16819 | 16820 |
| ADI-56040 | 16912 | 16913 | 16914 | 16915 | 16916 | 16917 | 16918 | 16919 | 16920 |
| ADI-56041 | 17012 | 17013 | 17014 | 17015 | 17016 | 17017 | 17018 | 17019 | 17020 |
| ADI-56042 | 17112 | 17113 | 17114 | 17115 | 17116 | 17117 | 17118 | 17119 | 17120 |
| ADI-56043 | 17212 | 17213 | 17214 | 17215 | 17216 | 17217 | 17218 | 17219 | 17220 |
| ADI-56044 | 17312 | 17313 | 17314 | 17315 | 17316 | 17317 | 17318 | 17319 | 17320 |
| ADI-56045 | 17412 | 17413 | 17414 | 17415 | 17416 | 17417 | 17418 | 17419 | 17420 |
| ADI-56046 | 17512 | 17513 | 17514 | 17515 | 17516 | 17517 | 17518 | 17519 | 17520 |

FIG. 2G

| AD ID | VL Protein SEQ ID NO: | VL FR1 Protein SEQ ID NO: | VL CDR1 Protein SEQ ID NO: | VL FR2 Protein SEQ ID NO: | VL CDR2 Protein SEQ ID NO: | VL FR3 Protein SEQ ID NO: | VL CDR3 Protein SEQ ID NO: | VL FR4 Protein SEQ ID NO: | VL DNA SEQ ID NO: |
|---|---|---|---|---|---|---|---|---|---|
| ADI-56047 | 17612 | 17613 | 17614 | 17615 | 17616 | 17617 | 17618 | 17619 | 17620 |
| ADI-56048 | 17712 | 17713 | 17714 | 17715 | 17716 | 17717 | 17718 | 17719 | 17720 |
| ADI-56049 | 17812 | 17813 | 17814 | 17815 | 17816 | 17817 | 17818 | 17819 | 17820 |
| ADI-56050 | 17912 | 17913 | 17914 | 17915 | 17916 | 17917 | 17918 | 17919 | 17920 |
| ADI-56051 | 18012 | 18013 | 18014 | 18015 | 18016 | 18017 | 18018 | 18019 | 18020 |
| ADI-56052 | 18112 | 18113 | 18114 | 18115 | 18116 | 18117 | 18118 | 18119 | 18120 |
| ADI-56053 | 18212 | 18213 | 18214 | 18215 | 18216 | 18217 | 18218 | 18219 | 18220 |
| ADI-56054 | 18312 | 18313 | 18314 | 18315 | 18316 | 18317 | 18318 | 18319 | 18320 |
| ADI-56055 | 18412 | 18413 | 18414 | 18415 | 18416 | 18417 | 18418 | 18419 | 18420 |
| ADI-56056 | 18512 | 18513 | 18514 | 18515 | 18516 | 18517 | 18518 | 18519 | 18520 |
| ADI-56057 | 18612 | 18613 | 18614 | 18615 | 18616 | 18617 | 18618 | 18619 | 18620 |
| ADI-56058 | 18712 | 18713 | 18714 | 18715 | 18716 | 18717 | 18718 | 18719 | 18720 |
| ADI-56059 | 18812 | 18813 | 18814 | 18815 | 18816 | 18817 | 18818 | 18819 | 18820 |
| ADI-56061 | 18912 | 18913 | 18914 | 18915 | 18916 | 18917 | 18918 | 18919 | 18920 |
| ADI-56062 | 19012 | 19013 | 19014 | 19015 | 19016 | 19017 | 19018 | 19019 | 19020 |
| ADI-56063 | 19112 | 19113 | 19114 | 19115 | 19116 | 19117 | 19118 | 19119 | 19120 |
| ADI-56064 | 19212 | 19213 | 19214 | 19215 | 19216 | 19217 | 19218 | 19219 | 19220 |
| ADI-56065 | 19312 | 19313 | 19314 | 19315 | 19316 | 19317 | 19318 | 19319 | 19320 |
| ADI-56066 | 19412 | 19413 | 19414 | 19415 | 19416 | 19417 | 19418 | 19419 | 19420 |
| ADI-56067 | 19512 | 19513 | 19514 | 19515 | 19516 | 19517 | 19518 | 19519 | 19520 |
| ADI-56068 | 19612 | 19613 | 19614 | 19615 | 19616 | 19617 | 19618 | 19619 | 19620 |
| ADI-56069 | 19712 | 19713 | 19714 | 19715 | 19716 | 19717 | 19718 | 19719 | 19720 |
| ADI-56070 | 19812 | 19813 | 19814 | 19815 | 19816 | 19817 | 19818 | 19819 | 19820 |
| ADI-56071 | 19912 | 19913 | 19914 | 19915 | 19916 | 19917 | 19918 | 19919 | 19920 |
| ADI-56072 | 20012 | 20013 | 20014 | 20015 | 20016 | 20017 | 20018 | 20019 | 20020 |

FIG. 2H

| ADI ID | VL Protein SEQ ID NO: | VL FR1 Protein SEQ ID NO: | VL CDR1 Protein SEQ ID NO: | VL FR2 Protein SEQ ID NO: | VL CDR2 Protein SEQ ID NO: | VL FR3 Protein SEQ ID NO: | VL CDR3 Protein SEQ ID NO: | VL FR4 Protein SEQ ID NO: | VL DNA SEQ ID NO: |
|---|---|---|---|---|---|---|---|---|---|
| ADI-56073 | 20112 | 20113 | 20114 | 20115 | 20116 | 20117 | 20118 | 20119 | 20120 |
| ADI-56074 | 20212 | 20213 | 20214 | 20215 | 20216 | 20217 | 20218 | 20219 | 20220 |
| ADI-56075 | 20312 | 20313 | 20314 | 20315 | 20316 | 20317 | 20318 | 20319 | 20320 |
| ADI-56076 | 20412 | 20413 | 20414 | 20415 | 20416 | 20417 | 20418 | 20419 | 20420 |
| ADI-56078 | 20512 | 20513 | 20514 | 20515 | 20516 | 20517 | 20518 | 20519 | 20520 |
| ADI-56079 | 20612 | 20613 | 20614 | 20615 | 20616 | 20617 | 20618 | 20619 | 20620 |
| ADI-56080 | 20712 | 20713 | 20714 | 20715 | 20716 | 20717 | 20718 | 20719 | 20720 |
| ADI-56081 | 20812 | 20813 | 20814 | 20815 | 20816 | 20817 | 20818 | 20819 | 20820 |
| ADI-56082 | 20912 | 20913 | 20914 | 20915 | 20916 | 20917 | 20918 | 20919 | 20920 |
| ADI-56083 | 21012 | 21013 | 21014 | 21015 | 21016 | 21017 | 21018 | 21019 | 21020 |
| ADI-56084 | 21112 | 21113 | 21114 | 21115 | 21116 | 21117 | 21118 | 21119 | 21120 |

FIG. 21

| ADI ID | VH Germline Origin | VL Germline Origin |
|---|---|---|
| ADI-55688 | IGHV3-21 | IGLV1-40 |
| ADI-55689 | IGHV3-64D | IGKV3-11 |
| ADI-55690 | IGHV4-39 | IGKV1D-39 |
| ADI-55691 | IGHV3-21 | IGLV1-40 |
| ADI-55692 | IGHV3-49 | IGKV1D-39 |
| ADI-55693 | IGVH3-21 | IGLV1-40 |
| ADI-55694 | IGHV1-8 | IGKV1D-39 |
| ADI-55695 | IGHV3-53 | IGKV3D-15 |
| ADI-55696 | IGHV1-69 | IGKV2-30 |
| ADI-55697 | IGHV1-8 | IGKV1D-39 |
| ADI-55698 | IGHV3-53 | IGKV3D-15 |
| ADI-55699 | IGHV3-30 | IGKV1-33 |
| ADI-55700 | IGHV1-69 | IGKV2-30 |
| ADI-55701 | IGHV1-69 | IGKV2-30 |
| ADI-55702 | IGVH1-69 | IGKV2-30 |
| ADI-55703 | IGHV3-30 | IGKV4-1 |
| ADI-55704 | IGHV1-69 | IGKV2-30 |
| ADI-55705 | IGHV1-69 | IGKV2-30 |
| ADI-55706 | IGHV1-69 | IGKV2-30 |
| ADI-55707 | IGHV4-34 | IGLV2-23 |
| ADI-55708 | IGHV4-34 | IGLV1-51 |
| ADI-55709 | IGVH4-34 | IGLV1-51 |
| ADI-55710 | IGHV4-61 | IGLV1-40 |
| ADI-55711 | IGHV3-23 | IGLV1-40 |
| ADI-55712 | IGHV1-69 | IGKV2-30 |

| ADI ID | VH Germline Origin | VL Germline Origin |
|---|---|---|
| ADI-55713 | IGVH4-61 | IGLV1-40 |
| ADI-55714 | IGHV3-53 | IGKV3D-15 |
| ADI-55715 | IGHV1-69 | IGKV2-30 |
| ADI-55716 | IGHV4-4 | IGKV3-20 |
| ADI-55717 | IGVH1-69 | IGKV2-30 |
| ADI-55718 | IGHV4-4 | IGKV3-20 |
| ADI-55719 | IGHV4-34 | IGLV1-51 |
| ADI-55721 | IGHV1-69 | IGKV2-30 |
| ADI-55722 | IGHV3-11 | IGKV3-20 |
| ADI-55723 | IGHV1-69 | IGKV2-30 |
| ADI-55724 | IGHV1-69 | IGKV3-11 |
| ADI-55725 | IGHV1-69 | IGKV2-30 |
| ADI-55726 | IGHV1-69 | IGKV2-30 |
| ADI-55727 | IGHV1-2 | IGLV6-57 |
| ADI-55728 | IGHV1-69 | IGKV2-30 |
| ADI-55729 | IGHV1-69 | IGKV2-30 |
| ADI-55730 | IGHV4-4 | IGKV3-20 |
| ADI-55731 | IGHV1-69 | IGKV2-30 |
| ADI-55732 | IGHV1-69 | IGKV3-11 |
| ADI-55733 | IGHV3-49 | IGKV3-11 |
| ADI-55734 | IGHV3-33 | IGLV7-46 |
| ADI-55735 | IGHV3-30 | IGKV1-27 |
| ADI-55736 | IGHV1-69 | IGKV2-30 |
| ADI-55737 | IGHV3-64D | IGKV1-12 |
| ADI-55738 | IGVH3-30 | IGKV3-11 |

FIG. 3A

| ADI ID | VH Germline Origin | VL Germline Origin |
|---|---|---|
| ADI-55739 | IGHV1-69 | IGKV2-30 |
| ADI-55740 | IGHV3-30 | IGKV3-11 |
| ADI-55741 | IGHV1-69 | IGKV2-30 |
| ADI-55742 | IGHV1-69 | IGKV2-30 |
| ADI-55743 | IGHV1-69 | IGKV2-30 |
| ADI-55744 | IGVH1-69 | IGKV2-30 |
| ADI-55745 | IGHV1-69 | IGKV2-30 |
| ADI-55746 | IGHV3-7 | IGLV2-14 |
| ADI-55747 | IGHV1-69 | IGKV2-30 |
| ADI-55748 | IGHV1-69 | IGKV2-30 |
| ADI-55749 | IGHV3-64D | IGKV1D-39 |
| ADI-55750 | IGHV3-23 | IGKV4-1 |
| ADI-55751 | IGHV4-34 | IGLV2-23 |
| ADI-55752 | IGHV3-11 | IGKV3-20 |
| ADI-55753 | IGHV3-30-3 | IGKV3-11 |
| ADI-55754 | IGHV3-64D | IGKV1D-39 |
| ADI-55755 | IGHV5-51 | IGKV1-5 |
| ADI-55756 | IGHV3-48 | IGLV2-11 |
| ADI-55757 | IGHV2-5 | IGLV1-36 |
| ADI-55758 | IGHV3-23 | IGKV2-30 |
| ADI-55720 | IGVH3-23 | N/A |
| ADI-55760 | IGHV4-4 | IGKV3-20 |
| ADI-55761 | IGHV1-69 | IGKV3-11 |
| ADI-55762 | IGHV4-4 | IGLV3-10 |
| ADI-55763 | IGHV4-4 | IGLV3-10 |

| ADI ID | VH Germline Origin | VL Germline Origin |
|---|---|---|
| ADI-55765 | IGHV4-4 | IGLV3-10 |
| ADI-55766 | IGHV3-74 | IGLV5-45 |
| ADI-55767 | IGHV3-23 | IGKV2-30 |
| ADI-55769 | IGHV3-9 | IGKV2D-29 |
| ADI-55770 | IGHV3-64D | IGKV3D-15 |
| ADI-55771 | IGHV3-48 | IGKV1-16 |
| ADI-55775 | IGHV4-59 | IGLV1-51 |
| ADI-55776 | IGHV1-46 | IGKV2D-29 |
| ADI-55777 | IGHV4-34 | IGKV4-1 |
| ADI-55950 | IGHV1-69 | IGKV2-30 |
| ADI-55951 | IGHV1-18 | IGKV4-1 |
| ADI-55952 | IGHV1-69 | IGKV2-30 |
| ADI-55953 | IGHV1-69 | IGKV2-30 |
| ADI-55954 | IGHV1-69 | IGKV2-30 |
| ADI-55955 | IGHV4-4 | IGLV2-14 |
| ADI-55956 | IGHV3-30 | IGKV1-5 |
| ADI-55957 | IGHV1-69 | IGKV2-30 |
| ADI-55958 | IGHV4-4 | IGKV1-9 |
| ADI-55959 | IGHV3-30-3 | IGKV3-11 |
| ADI-55960 | IGHV4-59 | IGLV2-14 |
| ADI-55961 | IGHV1-69 | IGKV2-30 |
| ADI-55962 | IGHV3-48 | IGLV2-11 |
| ADI-55963 | IGHV1-46 | IGKV4-1 |
| ADI-55964 | IGHV3-23 | IGLV2-14 |
| ADI-55965 | IGHV4-61 | IGKV3D-15 |

FIG. 3B

| ADI ID | VH Germline Origin | VL Germline Origin |
|---|---|---|
| ADI-55966 | IGHV1-69 | IGKV2-30 |
| ADI-55967 | IGHV1-69 | IGKV2-30 |
| ADI-55968 | IGHV1-69 | IGKV2-30 |
| ADI-55969 | IGHV3-23 | IGKV3D-15 |
| ADI-55970 | IGHV1-69 | IGKV2-30 |
| ADI-55972 | IGHV3-30-3 | IGKV3-11 |
| ADI-55973 | IGHV4-4 | IGLV3-10 |
| ADI-55974 | IGHV3-30-3 | IGKV3-11 |
| ADI-55975 | IGHV1-69 | IGKV2-30 |
| ADI-55976 | IGHV1-69 | IGKV2-30 |
| ADI-55977 | IGHV7-4-1 | IGKV1D-39 |
| ADI-55978 | IGHV4-34 | IGLV2-23 |
| ADI-55979 | IGHV4-4 | IGKV3-20 |
| ADI-55980 | IGHV3-30-3 | IGKV3-11 |
| ADI-55981 | IGHV1-69 | IGKV2-30 |
| ADI-55982 | IGHV1-69 | IGKV2-30 |
| ADI-55984 | IGHV1-69 | IGKV2-30 |
| ADI-55986 | IGHV3-33 | IGKV4-1 |
| ADI-55988 | IGHV4-4 | IGKV3-20 |
| ADI-55989 | IGHV5-51 | IGLV1-51 |
| ADI-55990 | IGHV1-69 | IGKV2-30 |
| ADI-55992 | IGHV3-23 | IGKV1-5 |
| ADI-55993 | IGHV1-2 | IGKV3-11 |
| ADI-55994 | IGHV1-2 | IGKV1D-39 |
| ADI-55995 | IGHV3-33 | IGKV3-11 |
| ADI-55996 | IGHV3-33 | IGKV3-11 |
| ADI-55997 | IGHV4-4 | IGLV3-10 |
| ADI-55998 | IGHV4-34 | IGLV2-23 |
| ADI-55999 | IGHV1-46 | IGKV4-1 |
| ADI-56000 | IGHV1-2 | IGKV3-11 |
| ADI-56001 | IGHV1-69 | IGKV3-11 |
| ADI-56002 | IGHV3-11 | IGKV3-20 |
| ADI-56003 | IGHV1-69 | IGLV4-60 |
| ADI-56004 | IGHV1-69 | IGLV4-60 |
| ADI-56005 | IGHV3-48 | IGKV1-17 |
| ADI-56006 | IGHV1-18 | IGKV2D-28 |
| ADI-56007 | IGHV4-30-4 | IGLV1-44 |
| ADI-56008 | IGHV3-9 | IGKV1D-39 |
| ADI-56009 | IGHV3-48 | IGKV3D-15 |
| ADI-56010 | IGHV4-39 | IGKV1D-39 |
| ADI-56011 | IGHV3-49 | IGKV3-11 |
| ADI-56012 | IGHV1-69 | IGLV4-69 |
| ADI-56013 | IGHV4-59 | IGLV6-57 |
| ADI-56014 | IGHV3-48 | IGKV3D-15 |
| ADI-56015 | IGHV1-69 | IGKV2-30 |
| ADI-56016 | IGHV3-30-3 | IGKV1-5 |
| ADI-56017 | IGHV3-7 | IGKV3D-15 |
| ADI-56018 | IGHV1-69 | IGKV2-30 |
| ADI-56019 | IGHV1-69 | IGKV2-30 |
| ADI-56020 | IGHV3-64D | IGKV1D-39 |

FIG. 3C

| ADI ID | VH Germline Origin | VL Germline Origin |
|---|---|---|
| ADI-56021 | IGHV1-69 | IGKV2-30 |
| ADI-56022 | IGHV1-69 | IGKV2-30 |
| ADI-56023 | IGHV3-30-3 | IGKV3-11 |
| ADI-56024 | IGHV3-11 | IGLV2-23 |
| ADI-56025 | IGHV3-30-3 | IGKV3-11 |
| ADI-56026 | IGHV3-30 | IGLV2-14 |
| ADI-56027 | IGHV1-69 | IGKV2-30 |
| ADI-56028 | IGHV1-69 | IGKV2-30 |
| ADI-56029 | IGHV1-69 | IGKV2-30 |
| ADI-56030 | IGHV1-69 | IGKV2-30 |
| ADI-56031 | IGHV1-69 | IGKV2-30 |
| ADI-56032 | IGHV1-2 | IGLV3-25 |
| ADI-56033 | IGHV3-21 | IGKV3-11 |
| ADI-56034 | IGHV3-53 | IGKV1D-39 |
| ADI-56035 | IGHV3-48 | IGKV1D-39 |
| ADI-56037 | IGHV1-69 | IGKV2-30 |
| ADI-56038 | IGHV1-69 | IGKV2-30 |
| ADI-56039 | IGHV3-11 | IGKV3-20 |
| ADI-56040 | IGHV2-5 | IGLV1-36 |
| ADI-56041 | IGHV3-30-3 | IGKV1-27 |
| ADI-56042 | IGHV4-34 | IGLV2-14 |
| ADI-56043 | IGHV3-30-3 | IGLV2-11 |
| ADI-56044 | IGHV3-15 | IGLV2-18 |
| ADI-56045 | IGHV1-69 | IGKV2-30 |
| ADI-56046 | IGHV3-53 | IGLV1-44 |
| ADI-56047 | IGHV3-23 | IGKV1D-39 |
| ADI-56048 | IGHV3-30-3 | IGKV1D-16 |
| ADI-56049 | IGHV1-69 | IGKV2-30 |
| ADI-56050 | IGHV1-69 | IGKV2-30 |
| ADI-56051 | IGHV4-39 | IGKV1D-39 |
| ADI-56052 | IGHV1-18 | IGKV3D-15 |
| ADI-56053 | IGHV3-48 | IGKV1-16 |
| ADI-56054 | IGHV1-18 | IGKV1D-39 |
| ADI-56055 | IGHV1-69 | IGKV2-30 |
| ADI-56056 | IGHV1-69 | IGKV2-30 |
| ADI-56057 | IGHV3-30 | IGKV4-1 |
| ADI-56058 | IGHV3-11 | IGKV1D-39 |
| ADI-56059 | IGHV3-30 | IGKV3-20 |
| ADI-56061 | IGHV1-69 | IGKV2-30 |
| ADI-56062 | IGHV1-69 | IGKV2-30 |
| ADI-56063 | IGHV1-69 | IGKV2-30 |
| ADI-56064 | IGHV1-69 | IGKV2-30 |
| ADI-56065 | IGHV4-34 | IGLV2-14 |
| ADI-56066 | IGHV4-34 | IGKV3-20 |
| ADI-56067 | IGHV1-69 | IGKV2-30 |
| ADI-56068 | IGHV4-59 | IGKV3-11 |
| ADI-56069 | IGHV1-69 | IGKV2-30 |
| ADI-56070 | IGHV4-39 | IGLV1-51 |
| ADI-56071 | IGHV3-64D | IGKV3-11 |
| ADI-56072 | IGHV3-30-3 | IGKV1D-16 |

FIG. 3D

| ADI ID | VH Nucleotide Substitutions | VL Nucleotide Substitutions | VH Amino Acid Substitutions | VL Amino Acid Substitutions |
|---|---|---|---|---|
| ADI-55688 | 13 | 3 | 10 | 3 |
| ADI-55689 | 14 | 12 | 11 | 10 |
| ADI-55690 | 21 | 9 | 17 | 9 |
| ADI-55691 | 11 | 1 | 7 | 1 |
| ADI-55692 | 13 | 9 | 13 | 5 |
| ADI-55693 | 8 | 4 | 8 | 4 |
| ADI-55694 | 8 | 4 | 8 | 4 |
| ADI-55695 | 26 | 10 | 19 | 10 |
| ADI-55696 | 23 | 6 | 17 | 5 |
| ADI-55697 | 11 | 6 | 9 | 5 |
| ADI-55698 | 27 | 10 | 21 | 9 |
| ADI-55699 | 13 | 12 | 11 | 11 |
| ADI-55700 | 22 | 6 | 17 | 6 |
| ADI-55701 | 31 | 12 | 22 | 11 |
| ADI-55702 | 15 | 2 | 12 | 2 |
| ADI-55703 | 26 | 5 | 19 | 5 |
| ADI-55704 | 25 | 4 | 20 | 4 |
| ADI-55705 | 25 | 17 | 19 | 15 |
| ADI-55706 | 10 | 21 | 8 | 12 |
| ADI-55707 | 9 | 2 | 7 | 2 |
| ADI-55708 | 18 | 6 | 13 | 6 |
| ADI-55709 | 12 | 4 | 8 | 4 |
| ADI-55710 | 23 | 4 | 18 | 3 |

FIG. 4A

| ADI ID | VH Germline Origin | VL Germline Origin |
|---|---|---|
| ADI-56073 | IGHV3-30 | IGKV4-1 |
| ADI-56074 | IGHV4-34 | IGLV1-51 |
| ADI-56075 | IGHV1-69 | IGKV2-30 |
| ADI-56076 | IGHV1-69 | IGKV2-30 |
| ADI-56078 | IGHV3-11 | IGKV1D-39 |
| ADI-56079 | IGHV3-53 | IGKV3D-15 |
| ADI-56080 | IGHV3-11 | IGKV3-20 |
| ADI-56081 | IGHV4-39 | IGKV3-20 |
| ADI-56082 | IGHV3-7 | IGKV4-1 |
| ADI-56083 | IGHV3-15 | IGLV2-14 |
| ADI-56084 | IGHV3-74 | IGLV1-47 |

| ADI ID | VH Nucleotide Substitutions | VL Nucleotide Substitutions | VH Amino Acid Substitutions | VL Amino Acid Substitutions |
|---|---|---|---|---|
| ADI-55713 | | | | |
| ADI-55714 | 25 | 12 | 21 | 12 |
| ADI-55715 | 19 | 3 | 15 | 3 |
| ADI-55716 | 10 | 2 | 9 | 2 |
| ADI-55717 | | | | |
| ADI-55718 | 14 | 5 | 13 | 5 |
| ADI-55719 | 7 | 1 | 6 | 1 |
| ADI-55721 | 23 | 9 | 17 | 9 |
| ADI-55722 | 19 | 22 | 15 | 15 |
| ADI-55723 | 27 | 8 | 18 | 7 |
| ADI-55724 | 6 | 6 | 6 | 6 |
| ADI-55725 | 30 | 11 | 18 | 8 |
| ADI-55726 | 31 | 12 | 20 | 10 |
| ADI-55727 | 26 | 9 | 17 | 8 |
| ADI-55728 | 28 | 15 | 20 | 11 |
| ADI-55729 | 26 | 9 | 20 | 9 |
| ADI-55730 | 16 | 5 | 15 | 3 |
| ADI-55731 | 24 | 8 | 18 | 8 |
| ADI-55732 | 6 | 6 | 6 | 6 |
| ADI-55733 | 13 | 6 | 13 | 5 |
| ADI-55734 | 11 | 4 | 8 | 4 |
| ADI-55735 | 24 | 12 | 17 | 9 |
| ADI-55736 | 21 | 2 | 16 | 2 |
| ADI-55737 | 16 | 8 | 11 | 7 |
| ADI-55738 | | | | |

FIG. 4C

| ADI ID | VH Nucleotide Substitutions | VL Nucleotide Substitutions | VH Amino Acid Substitutions | VL Amino Acid Substitutions |
|---|---|---|---|---|
| ADI-55739 | | | | |
| ADI-55740 | 26 | 12 | 18 | 11 |
| ADI-55741 | 26 | 7 | 15 | 7 |
| ADI-55742 | 30 | 8 | 21 | 7 |
| ADI-55743 | 17 | 3 | 15 | 3 |
| ADI-55744 | 26 | 15 | 17 | 12 |
| ADI-55745 | 25 | 12 | 17 | 11 |
| ADI-55746 | 9 | 23 | 8 | 13 |
| ADI-55747 | 15 | 10 | 12 | 9 |
| ADI-55748 | 27 | 13 | 18 | 11 |
| ADI-55749 | 14 | 8 | 11 | 6 |
| ADI-55750 | 17 | 4 | 11 | 4 |
| ADI-55751 | 11 | 12 | 9 | 10 |
| ADI-55752 | 19 | 23 | 14 | 19 |
| ADI-55753 | 36 | 14 | 27 | 13 |
| ADI-55754 | 15 | 8 | 13 | 7 |
| ADI-55755 | 13 | 9 | 11 | 7 |
| ADI-55756 | 31 | 20 | 19 | 15 |
| ADI-55757 | 14 | 16 | 12 | 15 |
| ADI-55758 | 15 | 4 | 13 | 4 |
| ADI-55720 | | | | |
| ADI-55760 | 18 | 13 | 14 | 12 |
| ADI-55761 | 23 | 4 | 20 | 4 |
| ADI-55762 | 13 | 8 | 11 | 7 |
| ADI-55763 | 15 | 8 | 12 | 7 |

FIG. 4D

| ADI ID | VH Nucleotide Substitutions | VL Nucleotide Substitutions | VH Amino Acid Substitutions | VL Amino Acid Substitutions |
|---|---|---|---|---|
| ADI-55765 | 13 | 8 | 11 | 7 |
| ADI-55766 | 21 | 16 | 17 | 13 |
| ADI-55767 | 14 | 4 | 12 | 4 |
| ADI-55769 | 9 | 3 | 8 | 3 |
| ADI-55770 | 6 | 3 | 5 | 1 |
| ADI-55771 | 16 | 13 | 13 | 10 |
| ADI-55775 | 6 | 4 | 6 | 4 |
| ADI-55776 | 25 | 8 | 17 | 7 |
| ADI-55777 | 4 | 5 | 4 | 3 |
| ADI-55950 | 20 | 9 | 15 | 6 |
| ADI-55951 | 21 | 4 | 16 | 4 |
| ADI-55952 | 22 | 7 | 16 | 7 |
| ADI-55953 | 18 | 7 | 12 | 6 |
| ADI-55954 | 31 | 13 | 22 | 10 |
| ADI-55955 | 13 | 6 | 11 | 5 |
| ADI-55956 | 13 | 2 | 10 | 2 |
| ADI-55957 | 28 | 10 | 21 | 9 |
| ADI-55958 | 6 | 5 | 6 | 5 |
| ADI-55959 | 29 | 11 | 22 | 11 |
| ADI-55960 | 9 | 6 | 7 | 6 |
| ADI-55961 | 30 | 13 | 22 | 10 |
| ADI-55962 | 31 | 19 | 19 | 15 |
| ADI-55963 | 6 | 3 | 6 | 3 |
| ADI-55964 | 14 | 14 | 10 | 13 |
| ADI-55965 | 27 | 9 | 24 | 6 |

FIG. 4E

| ADI ID | VH Nucleotide Substitutions | VL Nucleotide Substitutions | VH Amino Acid Substitutions | VL Amino Acid Substitutions |
|---|---|---|---|---|
| ADI-55966 | 15 | 10 | 12 | 9 |
| ADI-55967 | 30 | 9 | 20 | 8 |
| ADI-55968 | 31 | 9 | 20 | 8 |
| ADI-55969 | 25 | 4 | 20 | 4 |
| ADI-55970 | 28 | 8 | 20 | 7 |
| ADI-55972 | 29 | 11 | 22 | 11 |
| ADI-55973 | 13 | 9 | 11 | 8 |
| ADI-55974 | 26 | 20 | 18 | 16 |
| ADI-55975 | 24 | 2 | 19 | 2 |
| ADI-55976 | 25 | 5 | 19 | 5 |
| ADI-55977 | 9 | 8 | 9 | 8 |
| ADI-55978 | 16 | 8 | 12 | 8 |
| ADI-55979 | 15 | 18 | 13 | 16 |
| ADI-55980 | 26 | 20 | 18 | 16 |
| ADI-55981 | 31 | 12 | 22 | 11 |
| ADI-55982 | 33 | 12 | 24 | 9 |
| ADI-55984 | 25 | 11 | 19 | 10 |
| ADI-55986 | 0 | 0 | 0 | 0 |
| ADI-55988 | 20 | 7 | 14 | 5 |
| ADI-55989 | 15 | 3 | 13 | 2 |
| ADI-55990 | 24 | 11 | 18 | 8 |
| ADI-55992 | 18 | 2 | 15 | 2 |
| ADI-55993 | 18 | 1 | 15 | 1 |
| ADI-55994 | 10 | 6 | 8 | 5 |
| ADI-55995 | 25 | 6 | 17 | 5 |

| AD ID | VH Nucleotide Substitutions | VL Nucleotide Substitutions | VH Amino Acid Substitutions | VL Amino Acid Substitutions |
|---|---|---|---|---|
| ADI-55996 | 21 | 5 | 15 | 4 |
| ADI-55997 | 13 | 7 | 11 | 6 |
| ADI-55998 | 11 | 4 | 10 | 2 |
| ADI-55999 | 8 | 3 | 8 | 3 |
| ADI-56000 | 17 | 2 | 13 | 2 |
| ADI-56001 | 3 | 4 | 3 | 4 |
| ADI-56002 | 19 | 24 | 14 | 20 |
| ADI-56003 | 8 | 6 | 8 | 6 |
| ADI-56004 | 12 | 10 | 12 | 9 |
| ADI-56005 | 7 | 5 | 6 | 5 |
| ADI-56006 | 18 | 0 | 14 | 0 |
| ADI-56007 | 12 | 8 | 10 | 7 |
| ADI-56008 | 7 | 6 | 5 | 5 |
| ADI-56009 | 12 | 5 | 11 | 4 |
| ADI-56010 | 19 | 5 | 13 | 4 |
| ADI-56011 | 12 | 7 | 10 | 4 |
| ADI-56012 | 12 | 5 | 11 | 5 |
| ADI-56013 | 8 | 7 | 8 | 4 |
| ADI-56014 | 12 | 5 | 11 | 4 |
| ADI-56015 | 35 | 16 | 25 | 14 |
| ADI-56016 | 9 | 3 | 8 | 3 |
| ADI-56017 | 10 | 5 | 7 | 4 |
| ADI-56018 | 17 | 7 | 11 | 7 |
| ADI-56019 | 30 | 14 | 21 | 13 |
| ADI-56020 | 16 | 2 | 14 | 2 |

FIG. 4F

| AD ID | VH Nucleotide Substitutions | VL Nucleotide Substitutions | VH Amino Acid Substitutions | VL Amino Acid Substitutions |
|---|---|---|---|---|
| ADI-56021 | 25 | 10 | 18 | 9 |
| ADI-56022 | 33 | 10 | 23 | 6 |
| ADI-56023 | 27 | 13 | 18 | 11 |
| ADI-56024 | 7 | 6 | 6 | 5 |
| ADI-56025 | 27 | 13 | 18 | 11 |
| ADI-56026 | 9 | 9 | 8 | 8 |
| ADI-56027 | 40 | 9 | 24 | 7 |
| ADI-56028 | 25 | 5 | 19 | 5 |
| ADI-56029 | 31 | 13 | 22 | 10 |
| ADI-56030 | 25 | 5 | 19 | 5 |
| ADI-56031 | 19 | 4 | 15 | 3 |
| ADI-56032 | 14 | 6 | 12 | 6 |
| ADI-56033 | 6 | 3 | 6 | 3 |
| ADI-56034 | 9 | 7 | 7 | 6 |
| ADI-56035 | 9 | 4 | 8 | 3 |
| ADI-56037 | 17 | 4 | 13 | 4 |
| ADI-56038 | 30 | 11 | 18 | 8 |
| ADI-56039 | 21 | 13 | 16 | 11 |
| ADI-56040 | 8 | 9 | 7 | 8 |
| ADI-56041 | 25 | 15 | 20 | 12 |
| ADI-56042 | 12 | 3 | 11 | 3 |
| ADI-56043 | 9 | 4 | 7 | 4 |
| ADI-56044 | 35 | 12 | 26 | 11 |
| ADI-56045 | 20 | 6 | 18 | 6 |
| ADI-56046 | 12 | 3 | 10 | 3 |

FIG. 4G

| ADI ID | VH Nucleotide Substitutions | VL Nucleotide Substitutions | VH Amino Acid Substitutions | VL Amino Acid Substitutions |
|---|---|---|---|---|
| ADI-56047 | 13 | 11 | 10 | 9 |
| ADI-56048 | 27 | 12 | 19 | 9 |
| ADI-56049 | 25 | 9 | 20 | 9 |
| ADI-56050 | 30 | 11 | 18 | 8 |
| ADI-56051 | 16 | 12 | 13 | 8 |
| ADI-56052 | 25 | 4 | 18 | 4 |
| ADI-56053 | 16 | 14 | 13 | 11 |
| ADI-56054 | 11 | 6 | 9 | 5 |
| ADI-56055 | 25 | 5 | 19 | 5 |
| ADI-56056 | 16 | 3 | 14 | 3 |
| ADI-56057 | 19 | 10 | 15 | 9 |
| ADI-56058 | 10 | 7 | 9 | 5 |
| ADI-56059 | 7 | 4 | 6 | 4 |
| ADI-56061 | 26 | 8 | 18 | 7 |
| ADI-56062 | 31 | 12 | 21 | 10 |
| ADI-56063 | 16 | 3 | 14 | 3 |
| ADI-56064 | 26 | 9 | 19 | 9 |
| ADI-56065 | 7 | 7 | 6 | 6 |
| ADI-56066 | 14 | 9 | 11 | 8 |
| ADI-56067 | 30 | 13 | 22 | 10 |
| ADI-56068 | 9 | 2 | 9 | 2 |
| ADI-56069 | 21 | 8 | 16 | 6 |
| ADI-56070 | 8 | 1 | 7 | 1 |
| ADI-56071 | 14 | 12 | 11 | 10 |
| ADI-56072 | 25 | 8 | 19 | 7 |

FIG. 4H

| ADI ID | VH Nucleotide Substitutions | VL Nucleotide Substitutions | VH Amino Acid Substitutions | VL Amino Acid Substitutions |
|---|---|---|---|---|
| ADI-56073 | 1 | 0 | 10 | 0 |
| ADI-56074 | 18 | 4 | 14 | 4 |
| ADI-56075 | 15 | 3 | 13 | 3 |
| ADI-56076 | 34 | 4 | 26 | 3 |
| ADI-56078 | 8 | 5 | 7 | 4 |
| ADI-56079 | 24 | 11 | 20 | 10 |
| ADI-56080 | 15 | 17 | 12 | 14 |
| ADI-56081 | 9 | 2 | 7 | 2 |
| ADI-56082 | 7 | 2 | 5 | 2 |
| ADI-56083 | 22 | 12 | 16 | 12 |
| ADI-56084 | 14 | 12 | 8 | 12 |

FIG. 4I

| ADI ID | B Cell phenotype | ADI ID | B Cell phenotype | ADI ID | B Cell phenotype |
|---|---|---|---|---|---|
| ADI-55688 | IgG+ | ADI-55713 |  | ADI-55739 | IgA+ |
| ADI-55689 | IgG+ | ADI-55714 | IgA+ | ADI-55740 | IgA+ |
| ADI-55690 | IgG+ | ADI-55715 | IgG+ | ADI-55741 | IgG+ |
| ADI-55691 | IgG+ | ADI-55716 | IgG+ | ADI-55742 | IgG+ |
| ADI-55692 | IgG+ | ADI-55717 |  | ADI-55743 | IgG+ |
| ADI-55693 |  | ADI-55718 | IgG+ | ADI-55744 |  |
| ADI-55694 | IgG+ | ADI-55719 | IgG+ | ADI-55745 | IgG+ |
| ADI-55695 | IgG+ | ADI-55721 | IgG+ | ADI-55746 | IgG+ |
| ADI-55696 | IgG+ | ADI-55722 | IgG+ | ADI-55747 | IgG+ |
| ADI-55697 | IgG+ | ADI-55723 | IgG+ | ADI-55748 | IgG+ |
| ADI-55698 | IgG+ | ADI-55724 | IgG+ | ADI-55749 | IgG+ |
| ADI-55699 | IgG+ | ADI-55725 | IgG+ | ADI-55750 | IgG+ |
| ADI-55700 | IgG+ | ADI-55726 | IgG+ | ADI-55751 | IgG+ |
| ADI-55701 | IgG+ | ADI-55727 | IgG+ | ADI-55752 | IgA+ |
| ADI-55702 |  | ADI-55728 | IgG+ | ADI-55753 | IgG+ |
| ADI-55703 | IgG+ | ADI-55729 | IgG+ | ADI-55754 | IgG+ |
| ADI-55704 | IgG+ | ADI-55730 | IgG+ | ADI-55755 | IgG+ |
| ADI-55705 | IgG+ | ADI-55731 | IgG+ | ADI-55756 | IgA+ |
| ADI-55706 | IgG+ | ADI-55732 | IgA+ | ADI-55757 | IgG+ |
| ADI-55707 | IgG+ | ADI-55733 | IgG+ | ADI-55758 | IgG+ |
| ADI-55708 | IgG+ | ADI-55734 | IgG+ | ADI-55720 |  |
| ADI-55709 |  | ADI-55735 | IgG+ | ADI-55760 | IgG+ |
| ADI-55710 | IgG+ | ADI-55736 | IgG+ | ADI-55761 | IgG+ |
| ADI-55711 | IgG+ | ADI-55737 | IgA+ | ADI-55762 | IgG+ |
| ADI-55712 | IgG+ | ADI-55738 |  | ADI-55763 | IgA+ |

FIG. 5A

| ADI ID | B Cell phenotype |
|---|---|
| ADI-55765 | IgA+ |
| ADI-55766 | IgG+ |
| ADI-55767 | IgG+ |
| ADI-55769 | IgG+ |
| ADI-55770 | IgG+ |
| ADI-55771 | IgA+ |
| ADI-55775 | IgG+ |
| ADI-55776 | IgG+ |
| ADI-55777 | IgG+ |
| ADI-55950 | IgA+ |
| ADI-55951 | IgG+ |
| ADI-55952 | IgG+ |
| ADI-55953 | IgA+ |
| ADI-55954 | IgG+ |
| ADI-55955 | IgG+ |
| ADI-55956 | IgG+ |
| ADI-55957 | IgG+ |
| ADI-55958 | IgG+ |
| ADI-55959 | IgA+ |
| ADI-55960 | IgG+ |
| ADI-55961 | IgG+ |
| ADI-55962 | IgA+ |
| ADI-55963 | IgG+ |
| ADI-55964 | IgG+ |
| ADI-55965 | IgG+ |

| ADI ID | B Cell phenotype |
|---|---|
| ADI-55966 | IgG+ |
| ADI-55967 | IgA+ |
| ADI-55968 | IgA+ |
| ADI-55969 | IgG+ |
| ADI-55970 | IgA+ |
| ADI-55972 | IgA+ |
| ADI-55973 | IgA+ |
| ADI-55974 | IgA+ |
| ADI-55975 | IgA+ |
| ADI-55976 | IgA+ |
| ADI-55977 | IgG+ |
| ADI-55978 | IgG+ |
| ADI-55979 | IgA+ |
| ADI-55980 | IgA+ |
| ADI-55981 | IgG+ |
| ADI-55982 | IgG+ |
| ADI-55984 | IgG+ |
| ADI-55986 | IgG+ |
| ADI-55988 | IgG+ |
| ADI-55989 | IgG+ |
| ADI-55990 | IgG+ |
| ADI-55992 | IgG+ |
| ADI-55993 | IgG+ |
| ADI-55994 | IgG+ |
| ADI-55995 | IgG+ |

| ADI ID | B Cell phenotype |
|---|---|
| ADI-55996 | IgG+ |
| ADI-55997 | IgA+ |
| ADI-55998 | IgG+ |
| ADI-55999 | IgG+ |
| ADI-56000 | IgG+ |
| ADI-56001 | IgG+ |
| ADI-56002 | IgA+ |
| ADI-56003 | IgG+ |
| ADI-56004 | IgG+ |
| ADI-56005 | IgG+ |
| ADI-56006 | IgG+ |
| ADI-56007 | IgA+ |
| ADI-56008 | IgA+ |
| ADI-56009 | IgA+ |
| ADI-56010 | IgG+ |
| ADI-56011 | IgG+ |
| ADI-56012 | IgG+ |
| ADI-56013 | IgA+ |
| ADI-56014 | IgG+ |
| ADI-56015 | IgG+ |
| ADI-56016 | IgG+ |
| ADI-56017 | IgG+ |
| ADI-56018 | IgA+ |
| ADI-56019 | IgG+ |
| ADI-56020 | IgG+ |

FIG. 5B

| ADI ID | B Cell phenotype |
|---|---|
| ADI-56021 | IgG+ |
| ADI-56022 | IgG+ |
| ADI-56023 | IgA+ |
| ADI-56024 | IgG+ |
| ADI-56025 | IgG+ |
| ADI-56026 | IgG+ |
| ADI-56027 | IgA+ |
| ADI-56028 | IgG+ |
| ADI-56029 | IgG+ |
| ADI-56030 | IgA+ |
| ADI-56031 | IgA+ |
| ADI-56032 | IgG+ |
| ADI-56033 | IgG+ |
| ADI-56034 | IgG+ |
| ADI-56035 | IgG+ |
| ADI-56037 | IgG+ |
| ADI-56038 | IgG+ |
| ADI-56039 | IgA+ |
| ADI-56040 | IgG+ |
| ADI-56041 | IgG+ |
| ADI-56042 | IgG+ |
| ADI-56043 | IgG+ |
| ADI-56044 | IgG+ |
| ADI-56045 | IgA+ |
| ADI-56046 | IgG+ |

| ADI ID | B Cell phenotype |
|---|---|
| ADI-56047 | IgA+ |
| ADI-56048 | IgG+ |
| ADI-56049 | IgG+ |
| ADI-56050 | IgG+ |
| ADI-56051 | IgG+ |
| ADI-56052 | IgG+ |
| ADI-56053 | IgA+ |
| ADI-56054 | IgG+ |
| ADI-56055 | IgA+ |
| ADI-56056 | IgG+ |
| ADI-56057 | IgA+ |
| ADI-56058 | IgG+ |
| ADI-56059 | IgG+ |
| ADI-56061 | IgA+ |
| ADI-56062 | IgG+ |
| ADI-56063 | IgG+ |
| ADI-56064 | IgG+ |
| ADI-56065 | IgA+ |
| ADI-56066 | IgG+ |
| ADI-56067 | IgG+ |
| ADI-56068 | IgG+ |
| ADI-56069 | IgG+ |
| ADI-56070 | IgA+ |
| ADI-56071 | IgG+ |
| ADI-56072 | IgG+ |

| ADI ID | B Cell phenotype |
|---|---|
| ADI-56073 | IgG+ |
| ADI-56074 | IgG+ |
| ADI-56075 | IgA+ |
| ADI-56076 | IgA+ |
| ADI-56078 | IgG+ |
| ADI-56079 | IgA+ |
| ADI-56080 | IgA+ |
| ADI-56081 | IgG+ |
| ADI-56082 | IgG+ |
| ADI-56083 | IgA+ |
| ADI-56084 | IgG+ |

FIG. 5C

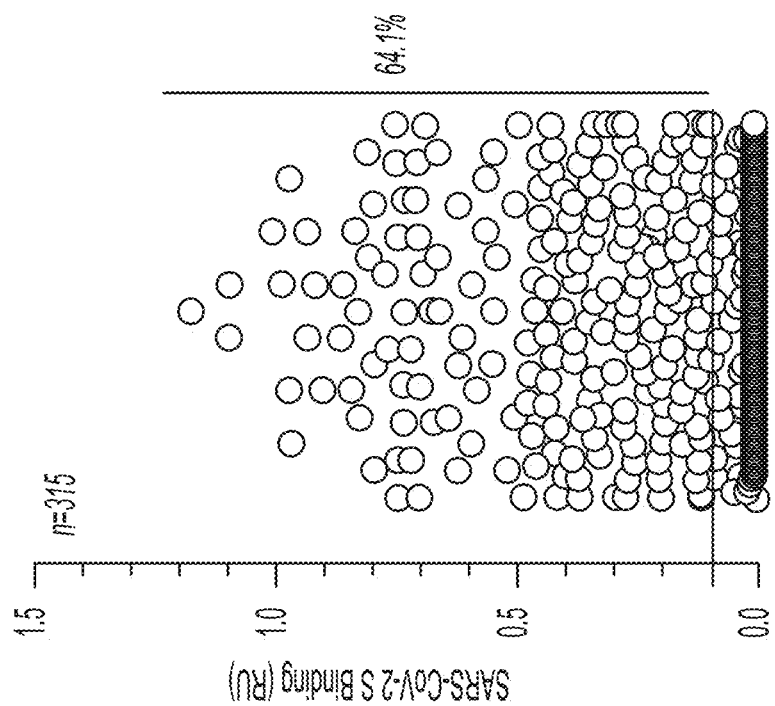
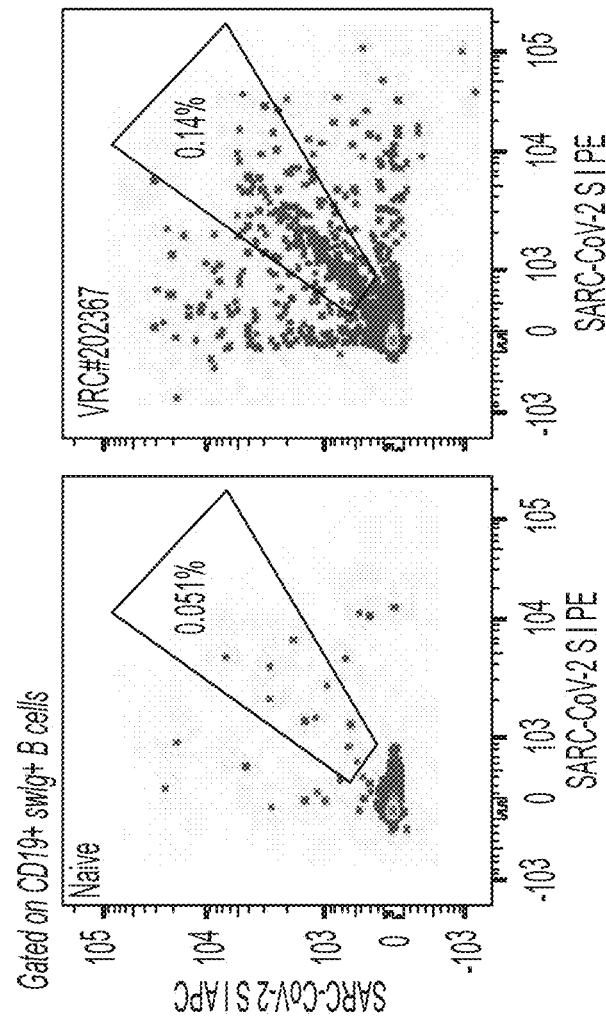
FIG. 6A
FIG. 6B

| ADI ID | SARS-CoV-S KD [M] | SARS-CoV-S kon [$M^{-1} s^{-1}$] | SARS-CoV-S koff [$s^{-1}$] | SARS-CoV-S Binding Response (nm) | SARS-CoV-2-S KD [M] | SARS-CoV-2-S kon [$M^{-1} s^{-1}$] | SARS-CoV-2-S koff [$s^{-1}$] | SARS-CoV-2-S Binding Response (nm) |
|---|---|---|---|---|---|---|---|---|
| ADI-55688 | 4.84E-10 | 4.14E+05 | 2.00E-04 | 1.05 | 4.59E-10 | 4.36E+05 | 2.00E-04 | 1.01 |
| ADI-55689 | 6.13E-10 | 3.26E+05 | 2.00E-04 | 1.045 | 4.14E-10 | 4.83E+05 | 2.00E-04 | 1.18 |
| ADI-55690 | 8.98E-10 | 2.23E+05 | 2.00E-04 | 0.883 | 1.00E-06 | 5.78E+05 | 2.00E-04 | 1.10 |
| ADI-55691 | 6.44E-10 | 3.10E+05 | 2.00E-04 | 0.833 | 6.98E-08 | 8.62E+05 | 6.01E-02 | 0.14 |
| ADI-55692 | 8.78E-10 | 2.28E+05 | 2.00E-04 | 0.817 | 5.56E-09 | 3.74E+05 | 2.08E-03 | 0.75 |
| ADI-55693 | | | | | | | | |
| ADI-55694 | 1.04E-09 | 1.93E+05 | 2.00E-04 | 0.761 | 1.66E-09 | 1.20E=05 | 2.00E-04 | 0.55 |
| ADI-55695 | 1.00E-06 | | | 0.652 | 1.00E-06 | | | 0.57 |
| ADI-55696 | 1.00E-06 | | | 0.605 | 1.31E-08 | 2.11E+06 | 2.76E-02 | 0.51 |
| ADI-55697 | 1.41E-09 | 1.41E+05 | 2.00E-04 | 0.579 | 3.21E-07 | 9.51E+04 | 3.06E-02 | 0.15 |
| ADI-55698 | 1.00E-06 | | | 0.55 | 1.00E-06 | | | 0.42 |
| ADI-55699 | 2.53E-09 | 7.89E+04 | 2.00E-04 | 0.54 | 1.13E-09 | 1.78E+05 | 2.00E-04 | 0.75 |
| ADI-55700 | 1.00E-06 | | | 0.502 | 2.21E-08 | 1.47E+06 | 3.26E-02 | 0.44 |
| ADI-55701 | 1.00E-06 | | | 0.494 | 1.00E-06 | | | 0.38 |
| ADI-55702 | | | | | | | | |
| ADI-55703 | 2.03E-09 | 9.83E+04 | 2.00E-04 | 0.488 | 5.17E-10 | 3.87E+05 | 2.00E-04 | 0.72 |
| ADI-55704 | 1.00E-06 | | | 0.471 | 1.00E-06 | | | 0.44 |
| ADI-55705 | 1.00E-06 | | | 0.458 | 1.00E-06 | | | 0.30 |
| ADI-55706 | 1.00E-06 | | | 0.453 | 1.00E-06 | | | 0.40 |
| ADI-55707 | 2.47E-09 | 8.10E+04 | 2.00E-04 | 0.442 | 8.84E-10 | 2.26E+05 | 2.00E-04 | 0.63 |
| ADI-55708 | 2.70E-09 | 7.40E+04 | 2.00E-04 | 0.438 | 1.03E-09 | 1.95E+05 | 2.00E-04 | 0.77 |
| ADI-55709 | | | | | | | | |
| ADI-55710 | 2.72E-09 | 7.34E+04 | 2.00E-04 | 0.427 | 2.97E-09 | 5.41E+05 | 1.60E-03 | 0.87 |
| ADI-55711 | 2.35E-09 | 8.52E+04 | 2.00E-04 | 0.424 | 4.48E-10 | 4.46E+05 | 2.00E-04 | 0.80 |
| ADI-55712 | 1.00E-06 | | | 0.415 | 2.77E-08 | 1.36E+06 | 3.76E-02 | 0.38 |

FIG. 7A

| ADI ID | SARS-CoV-S KD [M] | SARS-CoV-S kon [$M^{-1}$ $s^{-1}$] | SARS-CoV-S koff [$s^{-1}$] | SARS-CoV-S Binding Response (nm) | SARS-CoV-2-S KD [M] | SARS-CoV-2-S kon [$M^{-1}$ $s^{-1}$] | SARS-CoV-2-S koff [$s^{-1}$] | SARS-CoV-2-S Binding Response (nm) |
|---|---|---|---|---|---|---|---|---|
| ADI-55713 | | | | | | | | |
| ADI-55714 | 1.00E-06 | | | 0.405 | 1.00E-06 | | | 0.13 |
| ADI-55715 | 1.00E-06 | | | 0.4 | 1.00E-06 | | | 0.28 |
| ADI-55716 | 2.62E-09 | 7.63E+04 | 2.00E-04 | 0.4 | 9.66E-09 | 2.19E+05 | 2.12E-03 | 0.74 |
| ADI-55717 | | | | | | | | |
| ADI-55718 | 2.92E-09 | 6.84E+04 | 2.00E-04 | 0.399 | 1.08E-08 | 2.06E+05 | 2.22E-03 | 0.71 |
| ADI-55719 | 2.85E-09 | 7.03E+04 | 2.00E-04 | 0.384 | 1.18E-09 | 1.70E+05 | 2.00E-04 | 0.48 |
| ADI-55721 | 1.00E-06 | | | 0.377 | 3.26E-08 | 1.53E+06 | 4.97E-02 | 0.28 |
| ADI-55722 | 1.00E-06 | | | 0.374 | 1.00E-06 | | | 0.33 |
| ADI-55723 | 1.00E-06 | | | 0.363 | 1.00E-06 | | | 0.22 |
| ADI-55724 | 3.45E-09 | 5.79E+04 | 2.00E-04 | 0.36 | 6.60E-10 | 3.03E+05 | 2.00E-04 | 0.80 |
| ADI-55725 | 1.00E-06 | | | 0.346 | 1.00E-06 | | | 0.38 |
| ADI-55726 | 1.00E-06 | | | 0.337 | 1.00E-06 | | | 0.21 |
| ADI-55727 | 4.28E-09 | 4.68E+04 | 2.00E-04 | 0.335 | 4.95E-10 | 4.04E+05 | 2.00E-04 | 0.83 |
| ADI-55728 | 1.00E-06 | | | 0.333 | 1.00E-06 | | | 0.20 |
| ADI-55729 | 1.00E-06 | | | 0.331 | 1.00E-06 | | | 0.26 |
| ADI-55730 | 2.97E-09 | 6.74E+04 | 2.00E-04 | 0.324 | 1.92E-09 | 2.83E+05 | 5.43E-04 | 0.94 |
| ADI-55731 | 1.00E-06 | | | 0.321 | 1.00E-06 | | | 0.28 |
| ADI-55732 | 4.18E-09 | 4.78E+04 | 2.00E-04 | 0.31 | 7.06E-10 | 2.83E+05 | 2.00E-04 | 0.81 |
| ADI-55733 | 1.15E-09 | 1.74E+05 | 2.00E-04 | 0.304 | N.B. | | | 0.08 |
| ADI-55734 | 4.34E-09 | 4.61E+04 | 2.00E-04 | 0.297 | 8.68E-10 | 2.30E+05 | 2.00E-04 | 0.59 |
| ADI-55735 | 1.00E-06 | | | 0.296 | 1.00E-06 | | | 0.13 |
| ADI-55736 | 1.00E-06 | | | 0.295 | 1.00E-06 | | | 0.19 |
| ADI-55737 | 3.02E-09 | 6.63E+04 | 2.00E-04 | 0.286 | 6.97E-08 | 2.79E+05 | 1.94E-02 | 0.27 |
| ADI-55738 | | | | | | | | |

FIG. 7B

| ADI ID | SARS-CoV-S KD [M] | SARS-CoV-S kon [$M^{-1}$ $s^{-1}$] | SARS-CoV-S koff [$s^{-1}$] | SARS-CoV-S Binding Response (nm) | SARS-CoV-2-S KD [M] | SARS-CoV-2-S kon [$M^{-1}$ $s^{-1}$] | SARS-CoV-2-S koff [$s^{-1}$] | SARS-CoV-2-S Binding Response (nm) |
|---|---|---|---|---|---|---|---|---|
| ADI-55739 | 2.58E-09 | 8.85E+04 | 2.28E-04 | 0.284 | 1.00E-06 | | | 0.18 |
| ADI-55740 | 2.85E-07 | 1.26E+05 | 3.58E-02 | 0.266 | 6.46E-08 | 6.86E+05 | 4.43E-02 | 0.13 |
| ADI-55741 | 1.00E-06 | | | 0.259 | 1.00E-06 | | | 0.10 |
| ADI-55742 | 1.00E-06 | | | 0.256 | 1.00E-06 | | | 0.18 |
| ADI-55743 | 1.00E-06 | | | 0.255 | 1.00E-06 | | | 0.19 |
| ADI-55744 | | | | | | | | |
| ADI-55745 | 4.93E-09 | 8.39E+04 | 4.14E-04 | 0.237 | 1.00E-06 | | | 0.11 |
| ADI-55746 | 2.95E-09 | 6.79E+04 | 2.00E-04 | 0.233 | 2.19E-09 | 9.13E+04 | 2.00E-04 | 0.51 |
| ADI-55747 | 1.00E-06 | | | 0.229 | 1.00E-06 | | | 0.11 |
| ADI-55748 | 1.00E-06 | | | 0.227 | 1.00E-06 | | | 0.13 |
| ADI-55749 | 3.09E-09 | 6.47E+04 | 2.00E-04 | 0.203 | 1.10E-09 | 1.82E+05 | 2.00E-04 | 0.70 |
| ADI-55750 | 6.83E-08 | 1.69E+05 | 1.16E-02 | 0.171 | 6.24E-08 | 3.03E+05 | 1.89E-02 | 0.13 |
| ADI-55751 | 3.14E-09 | 6.38E+04 | 2.00E-04 | 0.167 | 7.28E-08 | 1.70E+05 | 1.23E-02 | 0.24 |
| ADI-55752 | 5.12E-09 | 1.06E+05 | 5.42E-04 | 0.148 | 1.00E-06 | | | 0.15 |
| ADI-55753 | 1.00E-06 | | | 0.124 | N.B. | | | 0.00 |
| ADI-55754 | 3.38E-09 | 5.92E+04 | 2.00E-04 | 0.123 | 1.48E-09 | 1.35E+05 | 2.00E-04 | 0.64 |
| ADI-55755 | 1.26E-07 | 1.54E+05 | 1.94E-02 | 0.112 | 3.80E-08 | 5.56E+05 | 2.11E-02 | 0.44 |
| ADI-55756 | 1.00E-06 | | | 0.106 | 8.07E-08 | 7.70E+05 | 6.22E-02 | 0.16 |
| ADI-55757 | N.B. | | | 0.092 | 3.27E-09 | 1.03E+05 | 3.36E-04 | 0.16 |
| ADI-55758 | N.B. | | | 0.073 | 4.24E-08 | 7.15E+05 | 3.03E-02 | 0.21 |
| ADI-55720 | | | | | | | | |
| ADI-55760 | N.B. | | | -0.017 | 7.71E-09 | 5.50E+04 | 4.24E-04 | 0.21 |
| ADI-55761 | N.B. | | | -0.009 | 1.50E-08 | 7.82E+04 | 1.17E-03 | 0.27 |
| ADI-55762 | N.B. | | | -0.011 | 1.86E-08 | 1.27E+06 | 2.37E-02 | 0.67 |
| ADI-55763 | N.B. | | | -0.007 | 1.95E-08 | 1.27E+06 | 2.48E-02 | 0.70 |

FIG. 7C

| ADI ID | SARS-CoV-S KD [M] | SARS-CoV-S kon [$M^{-1} s^{-1}$] | SARS-CoV-S koff [$s^{-1}$] | SARS-CoV-S Binding Response (nm) | SARS-CoV-2-S KD [M] | SARS-CoV-2-S kon [$M^{-1} s^{-1}$] | SARS-CoV-2-S koff [$s^{-1}$] | SARS-CoV-2-S Binding Response (nm) |
|---|---|---|---|---|---|---|---|---|
| ADI-55765 | N.B. | | | -0.004 | 2.10E-08 | 1.45E+06 | 3.05E-02 | 0.60 |
| ADI-55766 | N.B. | | | 0.065 | 3.51E-08 | 8.84E+05 | 3.10E-02 | 0.13 |
| ADI-55767 | N.B. | | | 0.045 | 4.12E-08 | 6.70E+05 | 2.76E-02 | 0.22 |
| ADI-55769 | N.B. | | | 0.007 | 1.20E-07 | 6.34E+05 | 7.60E-02 | 0.11 |
| ADI-55770 | N.B. | | | 0.031 | 1.91E-07 | 1.14E+06 | 2.18E-01 | 0.10 |
| ADI-55771 | N.B. | | | -0.002 | 2.76E-07 | 1.25E+05 | 3.46E-02 | 0.28 |
| ADI-55775 | N.B. | | | -0.006 | N.B. | | | 0.10 |
| ADI-55776 | N.B. | | | -0.002 | 1.00E-06 | | | 0.26 |
| ADI-55777 | N.B. | | | 0.003 | 1.00E-06 | | | 0.20 |
| ADI-55950 | 7.80E-08 | 6.80E+05 | 5.30E-02 | 0.229 | 1.00E-06 | | | 0.37 |
| ADI-55951 | 5.84E-10 | 3.42E+05 | 2.00E-04 | 0.925 | 5.38E-10 | 3.72E+05 | 2.00E-04 | 0.97 |
| ADI-55952 | 1.03E-07 | 6.00E+05 | 6.18E-02 | 0.166 | 1.00E-06 | | | 0.35 |
| ADI-55953 | 3.02E-08 | 1.21E+06 | 3.67E-02 | 0.305 | 1.00E-06 | | | 0.43 |
| ADI-55954 | 1.42E-07 | 5.83E+05 | 8.30E-02 | 0.148 | 1.00E-06 | | | 0.27 |
| ADI-55955 | 1.31E-07 | 6.45E+03 | 8.46E-04 | 0.1 | 8.16E-10 | 2.45E+05 | 2.00E-04 | 0.80 |
| ADI-55956 | 3.76E-09 | 5.31E+04 | 2.00E-04 | 0.127 | 3.46E-09 | 5.84E+05 | 2.02E-03 | 0.68 |
| ADI-55957 | 1.73E-07 | 3.37E+05 | 5.83E-02 | 0.139 | 1.00E-06 | | | 0.33 |
| ADI-55958 | 2.12E-09 | 9.41E+04 | 2.00E-04 | 0.377 | 1.43E-09 | 1.40E+05 | 2.00E-04 | 0.47 |
| ADI-55959 | 5.50E-08 | 6.99E+05 | 3.84E-02 | 0.213 | 1.00E-06 | | | 0.34 |
| ADI-55960 | N.B. | | | 0.093 | 9.90E-10 | 2.02E+05 | 2.00E-04 | 0.76 |
| ADI-55961 | 2.37E-08 | 1.08E+06 | 2.58E-02 | 0.38 | 1.00E-06 | | | 0.46 |
| ADI-55962 | 1.24E-07 | 3.25E+05 | 4.04E-02 | 0.108 | 1.00E-06 | | | 0.15 |
| ADI-55963 | N.B. | | | 0.029 | 1.18E-07 | 5.61E+05 | 6.64E-02 | 0.39 |
| ADI-55964 | 2.57E-08 | 6.38E+04 | 1.64E-03 | 0.158 | 4.18E-08 | 5.24E+05 | 2.19E-02 | 0.47 |
| ADI-55965 | 1.29E-07 | 7.12E+05 | 9.21E-02 | 0.159 | 1.00E-06 | | | 0.34 |

FIG. 7D

| ADI ID | SARS-CoV-S KD [M] | SARS-CoV-S kon [M⁻¹ s⁻¹] | SARS-CoV-S koff [s⁻¹] | SARS-CoV-S Binding Response (nm) | SARS-CoV-2-S KD [M] | SARS-CoV-2-S kon [M⁻¹ s⁻¹] | SARS-CoV-2-S koff [s⁻¹] | SARS-CoV-2-S Binding Response (nm) |
|---|---|---|---|---|---|---|---|---|
| ADI-55966 | N.B. | | | 0.091 | | | | 0.14 |
| ADI-55967 | 6.63E-08 | 8.27E+05 | 5.48E-02 | 0.144 | 1.00E-06 | | | 0.28 |
| ADI-55968 | 7.01E-08 | 7.91E+05 | 5.54E-02 | 0.148 | 1.00E-06 | | | 0.28 |
| ADI-55969 | 2.90E-09 | 6.91E+04 | 2.00E-04 | 0.253 | 5.40E-10 | 3.70E+05 | 2.00E-04 | 1.10 |
| ADI-55970 | N.B. | | | 0.065 | 1.00E-06 | | | 0.20 |
| ADI-55972 | 3.04E-08 | 9.81E+05 | 2.98E-02 | 0.205 | 1.00E-06 | | | 0.32 |
| ADI-55973 | N.B. | | | 0.097 | 3.15E-08 | 1.22E+06 | 3.83E-02 | 0.57 |
| ADI-55974 | 5.12E-08 | 1.14E+06 | 5.83E-02 | 0.217 | 1.00E-06 | | | 0.35 |
| ADI-55975 | N.B. | | | 0.099 | 1.00E-06 | | | 0.28 |
| ADI-55976 | 2.78E-08 | 1.08E+06 | 3.02E-02 | 0.361 | 1.00E-06 | | | 0.40 |
| ADI-55977 | 1.05E-09 | 1.91E+05 | 2.00E-04 | 0.755 | 1.18E-07 | 9.56E+04 | 1.12E-02 | 0.38 |
| ADI-55978 | 2.21E-08 | 3.32E+04 | 7.33E-04 | 0.137 | 7.88E-10 | 2.54E+05 | 2.00E-04 | 0.75 |
| ADI-55979 | N.B. | | | -0.004 | 1.49E-07 | 2.94E+04 | 4.39E-03 | 0.12 |
| ADI-55980 | 6.67E-08 | 8.33E+05 | 5.56E-02 | 0.243 | 1.00E-06 | | | 0.37 |
| ADI-55981 | N.B. | | | 0.078 | 1.00E-06 | | | 0.12 |
| ADI-55982 | 1.00E-06 | | | 0.164 | 1.00E-06 | | | 0.27 |
| ADI-55984 | 1.00E-06 | | | 0.262 | 1.00E-06 | | | 0.35 |
| ADI-55986 | N.B. | | | 0.043 | 5.31E-08 | 1.60E+06 | 8.51E-02 | 0.20 |
| ADI-55988 | 3.15E-09 | 6.36E+04 | 2.00E-04 | 0.136 | 1.85E-09 | 2.60E+05 | 4.81E-04 | 0.83 |
| ADI-55989 | 3.12E-09 | 6.42E+04 | 2.00E-04 | 0.147 | 7.53E-10 | 2.66E+05 | 2.00E-04 | 0.63 |
| ADI-55990 | 1.00E-06 | | | 0.298 | 1.00E-06 | | | 0.48 |
| ADI-55992 | N.B. | | | 0.083 | 1.35E-09 | 1.48E+05 | 2.00E-04 | 0.60 |
| ADI-55993 | 1.66E-09 | 1.21E+05 | 2.00E-04 | 0.61 | 1.21E-09 | 1.65E+05 | 2.00E-04 | 0.71 |
| ADI-55994 | 3.17E-09 | 6.32E+04 | 2.00E-04 | 0.158 | 4.54E-10 | 4.40E+05 | 2.00E-04 | 0.74 |
| ADI-55995 | N.B. | | | 0.012 | 1.98E-07 | 2.75E+05 | 5.46E-02 | 0.21 |

FIG. 7E

| ADI ID | SARS-CoV-S KD [M] | SARS-CoV-S kon [$M^{-1}$ $s^{-1}$] | SARS-CoV-S koff [$s^{-1}$] | SARS-CoV-S Binding Response (nm) | SARS-CoV-2-S KD [M] | SARS-CoV-2-S kon [$M^{-1}$ $s^{-1}$] | SARS-CoV-2-S koff [$s^{-1}$] | SARS-CoV-2-S Binding Response (nm) |
|---|---|---|---|---|---|---|---|---|
| ADI-55996 | N.B. | | | 0.009 | 1.00E-06 | | | 0.16 |
| ADI-55997 | N.B. | | | 0.068 | 2.32E-08 | 1.10E+06 | 2.55E-02 | 0.43 |
| ADI-55998 | N.B. | | | 0.088 | 9.50E-10 | 2.11E+05 | 2.00E-04 | 0.47 |
| ADI-55999 | N.B. | | | 0.01 | 1.00E-06 | | | 0.20 |
| ADI-56000 | 1.34E-09 | 1.49E+05 | 2.00E-04 | 0.64 | 1.13E-09 | 1.77E+05 | 2.00E-04 | 0.63 |
| ADI-56001 | N.B. | | | 0.018 | 3.09E-09 | 6.48E+04 | 2.00E-04 | 0.28 |
| ADI-56002 | 1.00E-06 | | | 0.129 | 1.00E-06 | | | 0.14 |
| ADI-56003 | N.B. | | | 0.061 | 1.28E-09 | 1.57E+05 | 2.00E-04 | 0.62 |
| ADI-56004 | 2.94E-09 | 6.81E+04 | 2.00E-04 | 0.16 | 8.68E-10 | 2.30E+05 | 2.00E-04 | 0.85 |
| ADI-56005 | 2.93E-09 | 6.82E+04 | 2.00E-04 | 0.102 | 9.43E-10 | 2.12E+05 | 2.00E-04 | 0.84 |
| ADI-56006 | N.B. | | | 0.087 | 1.31E-09 | 1.53E+05 | 2.00E-04 | 0.71 |
| ADI-56007 | 1.15E-09 | 1.73E+05 | 2.00E-04 | 0.557 | 5.41E-08 | 2.30E+05 | 1.24E-02 | 0.43 |
| ADI-56008 | 3.79E-08 | 6.63E+04 | 2.51E-03 | 0.204 | 2.30E-08 | 1.09E+06 | 2.51E-02 | 0.67 |
| ADI-56009 | N.B. | | | 0.035 | 1.00E-06 | | | 0.27 |
| ADI-56010 | 1.51E-09 | 1.32E+05 | 2.00E-04 | 0.689 | 3.90E-10 | 5.13E+05 | 2.00E-04 | 0.87 |
| ADI-56011 | 2.99E-09 | 6.69E+04 | 2.00E-04 | 0.302 | 5.93E-10 | 3.37E+05 | 2.00E-04 | 0.81 |
| ADI-56012 | N.B. | | | 0.06 | 7.80E-08 | 3.14E+05 | 2.45E-02 | 0.25 |
| ADI-56013 | N.B. | | | 0.003 | 1.09E-06 | 1.34E+05 | 1.47E-01 | 0.12 |
| ADI-56014 | N.B. | | | 0.029 | 1.00E-06 | | | 0.32 |
| ADI-56015 | 1.53E-07 | 3.14E+05 | 4.82E-02 | 0.131 | 1.00E-06 | | | 0.24 |
| ADI-56016 | 2.79E-09 | 7.16E+04 | 2.00E-04 | 0.226 | 5.48E-10 | 3.65E+05 | 2.00E-04 | 0.91 |
| ADI-56017 | 3.11E-09 | 6.42E+04 | 2.00E-04 | 0.244 | 3.04E-09 | 5.54E+05 | 1.68E-03 | 0.56 |
| ADI-56018 | N.B. | | | 0.048 | 1.00E-06 | | | 0.15 |
| ADI-56019 | 7.44E-08 | 7.48E+05 | 5.56E-02 | 0.25 | 1.00E-06 | | | 0.43 |
| ADI-56020 | N.B. | | | 0.056 | 3.33E-09 | 6.01E+04 | 2.00E-04 | 0.39 |

FIG. 7F

| ADI ID | SARS-CoV-S KD [M] | SARS-CoV-S kon [M⁻¹s⁻¹] | SARS-CoV-S koff [s⁻¹] | SARS-CoV-S Binding Response (nm) | SARS-CoV-2-S KD [M] | SARS-CoV-2-S kon [M⁻¹s⁻¹] | SARS-CoV-2-S koff [s⁻¹] | SARS-CoV-2-S Binding Response (nm) |
|---|---|---|---|---|---|---|---|---|
| ADI-56021 | N.B. | | | 0.056 | 1.00E-06 | | | 0.17 |
| ADI-56022 | 1.00E-06 | | | 0.332 | 1.00E-06 | | | 0.55 |
| ADI-56023 | 1.07E-07 | 4.42E+05 | 4.73E-02 | 0.139 | 1.00E-06 | | | 0.20 |
| ADI-56024 | 3.00E-09 | 6.66E+04 | 2.00E-04 | 0.163 | 2.62E-09 | 2.90E+05 | 7.60E-04 | 0.70 |
| ADI-56025 | 1.35E-07 | 3.22E+05 | 4.34E-02 | 0.129 | 1.00E-06 | | | 0.18 |
| ADI-56026 | 2.90E-09 | 6.91E+04 | 2.00E-04 | 0.253 | 7.40E-10 | 4.97E+05 | 3.68E-04 | 0.74 |
| ADI-56027 | 1.00E-06 | | | 0.207 | 1.00E-06 | | | 0.31 |
| ADI-56028 | 1.00E-06 | | | 0.388 | 1.00E-06 | | | 0.46 |
| ADI-56029 | 1.00E-06 | | | 0.176 | 1.00E-06 | | | 0.30 |
| ADI-56030 | 1.00E-06 | | | 0.36 | 1.00E-06 | | | 0.42 |
| ADI-56031 | 2.43E-08 | 1.53E+06 | 3.71E-02 | 0.361 | 1.00E-06 | | | 0.44 |
| ADI-56032 | 5.17E-10 | 3.87E+05 | 2.00E-04 | 0.854 | 3.04E-09 | 4.60E+05 | 1.40E-03 | 0.72 |
| ADI-56033 | N.B. | | | 0.01 | 2.77E-09 | 7.23E+04 | 2.00E-04 | 0.31 |
| ADI-56034 | N.B. | | | 0.038 | 2.78E-09 | 7.20E+04 | 2.00E-04 | 0.34 |
| ADI-56035 | 2.07E-09 | 9.66E+04 | 2.00E-04 | 0.444 | 1.98E-09 | 2.16E+05 | 4.28E-04 | 0.74 |
| ADI-56037 | 5.56E-08 | 9.65E+05 | 5.36E-02 | 0.22 | 1.00E-06 | | | 0.40 |
| ADI-56038 | 1.00E-06 | | | 0.249 | 1.00E-06 | | | 0.40 |
| ADI-56039 | N.B. | | | 0.072 | 1.00E-06 | | | 0.13 |
| ADI-56040 | 3.01E-09 | 6.64E+04 | 2.00E-04 | 0.208 | 2.05E-09 | 9.76E+04 | 2.00E-04 | 0.52 |
| ADI-56041 | N.B. | | | 0.079 | 1.00E-06 | | | 0.13 |
| ADI-56042 | N.B. | | | 0.073 | 1.26E-09 | 1.59E+05 | 2.00E-04 | 0.68 |
| ADI-56043 | 3.29E-09 | 6.09E+04 | 2.00E-04 | 0.296 | 4.27E-10 | 4.68E+05 | 2.00E-04 | 0.98 |
| ADI-56044 | 1.00E-06 | | | 0.136 | 1.00E-06 | | | 0.17 |
| ADI-56045 | 1.00E-06 | | | 0.284 | 1.00E-06 | | | 0.44 |
| ADI-56046 | 1.03E-09 | 1.95E+05 | 2.00E-04 | 0.771 | 3.49E-10 | 5.73E+05 | 2.00E-04 | 0.94 |

FIG. 7G

| ADI ID | SARS-CoV-S KD [M] | SARS-CoV-S kon [M⁻¹s⁻¹] | SARS-CoV-S koff [s⁻¹] | SARS-CoV-S Binding Response (nm) | SARS-CoV-2-S KD [M] | SARS-CoV-2-S kon [M⁻¹s⁻¹] | SARS-CoV-2-S koff [s⁻¹] | SARS-CoV-2-S Binding Response (nm) |
|---|---|---|---|---|---|---|---|---|
| ADI-56047 | N.B. | | | 0.022 | 1.28E-07 | 2.89E+05 | 3.71E-02 | 0.24 |
| ADI-56048 | N.B. | | | 0.088 | 1.00E-06 | | | 0.12 |
| ADI-56049 | 3.24E-08 | 5.68E+05 | 1.84E-02 | 0.383 | 1.00E-06 | | | 0.46 |
| ADI-56050 | 1.00E-06 | | | 0.279 | 1.00E-06 | | | 0.34 |
| ADI-56051 | 1.63E-09 | 1.23E+05 | 2.00E-04 | 0.593 | 2.89E-09 | 6.91E+04 | 2.00E-04 | 0.25 |
| ADI-56052 | 1.00E-06 | | | 0.147 | 1.00E-06 | | | 0.18 |
| ADI-56053 | N.B. | | | 0.015 | 1.51E-07 | | | 0.37 |
| ADI-56054 | 2.98E-09 | 6.71E+04 | 2.00E-04 | 0.203 | 2.42E-08 | 1.59E+05 | 2.40E-02 | 0.71 |
| ADI-56055 | 1.00E-06 | | | 0.443 | 1.00E-06 | 7.02E+05 | 1.70E-02 | 0.49 |
| ADI-56056 | 1.00E-06 | | | 0.124 | 1.00E-06 | | | 0.23 |
| ADI-56057 | 3.01E-08 | 1.20E+06 | 3.62E-02 | 0.315 | 1.00E-06 | | | 0.43 |
| ADI-56058 | 2.15E-09 | 9.30E+04 | 2.00E-04 | 0.477 | 2.67E-09 | 7.49E+04 | 2.00E-04 | 0.45 |
| ADI-56059 | 3.13E-09 | 6.38E+04 | 2.00E-04 | 0.301 | 4.47E-10 | 4.48E+05 | 2.00E-04 | 0.98 |
| ADI-56061 | 1.00E-06 | | | 0.247 | 1.00E-06 | | | 0.41 |
| ADI-56062 | 1.00E-06 | | | 0.198 | 1.00E-06 | | | 0.35 |
| ADI-56063 | 1.00E-07 | 5.98E+05 | 5.99E-02 | 0.227 | 1.00E-06 | | | 0.34 |
| ADI-56064 | 1.00E-06 | | | 0.281 | 1.00E-06 | | | 0.46 |
| ADI-56065 | N.B. | | | 0.085 | 1.62E-09 | 1.24E+05 | 2.00E-04 | 0.55 |
| ADI-56066 | N.B. | | | 0.053 | 6.25E-09 | 1.07E+05 | 6.71E-04 | 0.37 |
| ADI-56067 | 1.00E-06 | | | 0.348 | 1.00E-06 | | | 0.50 |
| ADI-56068 | N.B. | | | 0.059 | 2.61E-09 | 1.92E+05 | 5.01E-04 | 0.26 |
| ADI-56069 | 2.14E-08 | 7.82E+05 | 1.67E-02 | 0.384 | 1.00E-06 | | | 0.45 |
| ADI-56070 | N.B. | | | 0.073 | 7.17E-08 | 2.27E+05 | 1.63E-02 | 0.29 |
| ADI-56071 | 6.55E-10 | 3.05E+05 | 2.00E-04 | 0.726 | 5.03E-10 | 3.98E+05 | 2.00E-04 | 0.99 |
| ADI-56072 | N.B. | | | 0.069 | 8.74E-07 | 8.51E+04 | 7.43E-02 | 0.12 |

FIG. 7H

| ADI ID | SARS-CoV-S KD [M] | SARS-CoV-S kon [$M^{-1}$ $s^{-1}$] | SARS-CoV-S koff [$s^{-1}$] | SARS-CoV-S Binding Response (nm) | SARS-CoV-2-S KD [M] | SARS-CoV-2-S kon [$M^{-1}$ $s^{-1}$] | SARS-CoV-2-S koff [$s^{-1}$] | SARS-CoV-2-S Binding Response (nm) |
|---|---|---|---|---|---|---|---|---|
| ADI-56073 | 6.87E-09 | 2.91E+04 | 2.00E-04 | 0.197 | 6.25E-10 | 3.20E+05 | 2.00E-04 | 0.78 |
| ADI-56074 | 3.53E-09 | 5.67E+04 | 2.00E-04 | 0.111 | 9.43E-10 | 2.12E+05 | 2.00E-04 | 0.66 |
| ADI-56075 | 1.00E-06 | | | 0.123 | 1.00E-06 | | | 0.22 |
| ADI-56076 | 2.84E-08 | 6.38E+05 | 1.81E-02 | 0.333 | 1.00E-06 | | | 0.35 |
| ADI-56078 | N.B. | | | 0.018 | 1.00E-06 | | | 0.22 |
| ADI-56079 | 1.00E-06 | | | 0.203 | 1.00E-06 | | | 0.35 |
| ADI-56080 | 1.20E-07 | 4.42E+05 | 5.29E-02 | 0.175 | 1.00E-06 | | | 0.21 |
| ADI-56081 | 3.19E-09 | 6.27E+04 | 2.00E-04 | 0.161 | 5.80E-10 | 3.45E+05 | 2.00E-04 | 0.92 |
| ADI-56082 | 1.06E-07 | 8.50E+05 | 8.98E-02 | 0.198 | N.B. | | | 0.10 |
| ADI-56083 | N.B. | | | 0.098 | N.B. | | | 0.09 |
| ADI-56084 | 1.00E-06 | | | 0.109 | N.B. | | | 0.10 |

FIG. 7I

| ADI ID | HCoV-229E S KD [M] | HCoV-229E S kon | HCoV-229E S koff | HCoV-229E S Response |
|---|---|---|---|---|
| ADI-55688 | N.B. | | | 0.03 |
| ADI-55689 | N.B. | | | 0.03 |
| ADI-55690 | N.B. | | | 0.01 |
| ADI-55691 | N.B. | | | 0.01 |
| ADI-55692 | N.B. | | | 0.02 |
| ADI-55693 | | | | |
| ADI-55694 | N.B. | | | 0.03 |
| ADI-55695 | 2.68E-09 | 7.46E+04 | 2.00E-04 | 0.44 |
| ADI-55696 | 1.84E-09 | 1.09E+05 | 2.00E-04 | 0.25 |
| ADI-55697 | N.B. | | | 0.03 |
| ADI-55698 | 1.90E-09 | 1.05E+05 | 2.00E-04 | 0.32 |
| ADI-55699 | N.B. | | | 0.04 |
| ADI-55700 | 2.78E-09 | 7.20E+04 | 2.00E-04 | 0.18 |
| ADI-55701 | 1.00E-06 | | | 0.13 |
| ADI-55702 | | | | |
| ADI-55703 | N.B. | | | 0.03 |
| ADI-55704 | 1.81E-09 | 1.10E+05 | 2.00E-04 | 0.21 |
| ADI-55705 | N.B. | | | 0.10 |
| ADI-55706 | 1.63E-09 | 1.22E+05 | 2.00E-04 | 0.15 |
| ADI-55707 | N.B. | | | 0.02 |
| ADI-55708 | N.B. | | | 0.04 |
| ADI-55709 | | | | |
| ADI-55710 | N.B. | | | 0.04 |
| ADI-55711 | N.B. | | | 0.02 |
| ADI-55712 | 3.09E-09 | 6.47E+04 | 2.00E-04 | 0.14 |

| ADI ID | HCoV-229E S KD [M] | HCoV-229E S kon | HCoV-229E S koff | HCoV-229E S Response |
|---|---|---|---|---|
| ADI-55713 | | | | |
| ADI-55714 | 7.44E-09 | 1.73E+05 | 1.29E-03 | 0.18 |
| ADI-55715 | 1.00E-06 | | | 0.15 |
| ADI-55716 | N.B. | | | 0.05 |
| ADI-55717 | | | | |
| ADI-55718 | N.B. | | | 0.03 |
| ADI-55719 | N.B. | | | 0.04 |
| ADI-55721 | N.B. | | | 0.06 |
| ADI-55722 | 4.93E-09 | 4.05E+04 | 2.00E-04 | 0.24 |
| ADI-55723 | N.B. | | | 0.02 |
| ADI-55724 | N.B. | | | 0.03 |
| ADI-55725 | 1.00E-06 | | | 0.11 |
| ADI-55726 | N.B. | | | 0.07 |
| ADI-55727 | N.B. | | | 0.03 |
| ADI-55728 | N.B. | | | 0.04 |
| ADI-55729 | N.B. | | | 0.07 |
| ADI-55730 | N.B. | | | 0.03 |
| ADI-55731 | N.B. | | | 0.03 |
| ADI-55732 | N.B. | | | 0.05 |
| ADI-55733 | N.B. | | | 0.04 |
| ADI-55734 | N.B. | | | 0.03 |
| ADI-55735 | N.B. | | | 0.05 |
| ADI-55736 | N.B. | | | 0.04 |
| ADI-55737 | N.B. | | | 0.05 |
| ADI-55738 | | | | |

FIG. 8A

| AD ID | HCoV-229E S KD [M] | HCoV-229E S kon | HCoV-229E S koff | HCoV-229E S Response |
|---|---|---|---|---|
| AD-55739 | N.B. | | | 0.03 |
| AD-55740 | N.B. | | | 0.07 |
| AD-55741 | N.B. | | | 0.04 |
| AD-55742 | N.B. | | | 0.04 |
| AD-55743 | N.B. | | | 0.03 |
| AD-55744 | | | | |
| AD-55745 | N.B. | | | 0.03 |
| AD-55746 | N.B. | | | 0.04 |
| AD-55747 | N.B. | | | 0.04 |
| AD-55748 | N.B. | | | 0.04 |
| AD-55749 | N.B. | | | 0.03 |
| AD-55750 | N.B. | | | 0.03 |
| AD-55751 | N.B. | | | 0.04 |
| AD-55752 | 1.00E-06 | | | 0.13 |
| AD-55753 | N.B. | | | 0.04 |
| AD-55754 | N.B. | | | 0.03 |
| AD-55755 | N.B. | | | 0.03 |
| AD-55756 | N.B. | | | 0.02 |
| AD-55757 | N.B. | | | 0.04 |
| AD-55758 | N.B. | | | |
| AD-55720 | | | | 0.03 |
| AD-55760 | N.B. | | | 0.04 |
| AD-55761 | N.B. | | | 0.03 |
| AD-55762 | N.B. | | | 0.04 |
| AD-55763 | N.B. | | | |
| AD-55765 | N.B. | | | 0.03 |
| AD-55766 | N.B. | | | 0.07 |
| AD-55767 | N.B. | | | 0.04 |
| AD-55769 | N.B. | | | 0.03 |
| AD-55770 | N.B. | | | 0.04 |
| AD-55771 | N.B. | | | 0.02 |
| AD-55775 | N.B. | | | 0.04 |
| AD-55776 | N.B. | | | 0.01 |
| AD-55777 | N.B. | | | 0.04 |
| AD-55850 | 1.00E-06 | | | 0.15 |
| AD-55951 | N.B. | | | 0.05 |
| AD-55952 | N.B. | | | 0.07 |
| AD-55953 | 8.54E-09 | 8.34E+04 | 7.12E-04 | 0.28 |
| AD-55954 | N.B. | | | 0.04 |
| AD-55955 | N.B. | | | 0.04 |
| AD-55956 | N.B. | | | 0.05 |
| AD-55957 | N.B. | | | 0.06 |
| AD-55958 | N.B. | | | 0.04 |
| AD-55959 | 1.00E-06 | | | 0.26 |
| AD-55960 | N.B. | | | 0.04 |
| AD-55961 | 1.14E-08 | 8.03E+04 | 9.14E-04 | 0.26 |
| AD-55962 | N.B. | | | 0.08 |
| AD-55963 | N.B. | | | 0.05 |
| AD-55964 | N.B. | | | 0.05 |
| AD-55965 | 1.00E-06 | | | 0.12 |

FIG. 8B

| ADI ID | HCoV-229E S KD [M] | HCoV-229E S kon | HCoV-229E S koff | HCoV-229E S Response |
|---|---|---|---|---|
| ADI-55966 | N.B. | | | 0.05 |
| ADI-55967 | N.B. | | | 0.04 |
| ADI-55968 | N.B. | | | 0.06 |
| ADI-55969 | N.B. | | | 0.04 |
| ADI-55970 | N.B. | | | 0.05 |
| ADI-55972 | 1.12E-08 | 1.01E+05 | 1.12E-03 | 0.26 |
| ADI-55973 | N.B. | | | 0.05 |
| ADI-55974 | 7.98E-09 | 1.07E+05 | 8.55E-04 | 0.26 |
| ADI-55975 | N.B. | | | 0.05 |
| ADI-55976 | 6.56E-09 | 9.43E+04 | 6.19E-04 | 0.30 |
| ADI-55977 | N.B. | | | 0.03 |
| ADI-55978 | N.B. | | | 0.03 |
| ADI-55979 | N.B. | | | 0.03 |
| ADI-55980 | 4.02E-09 | 9.05E+04 | 3.64E-04 | 0.35 |
| ADI-55981 | N.B. | | | 0.04 |
| ADI-55982 | N.B. | | | 0.04 |
| ADI-55984 | 1.00E-06 | | | 0.18 |
| ADI-55986 | N.B. | | | 0.05 |
| ADI-55988 | N.B. | | | 0.04 |
| ADI-55989 | N.B. | | | 0.07 |
| ADI-55990 | 9.12E-09 | 1.11E+05 | 1.01E-03 | 0.33 |
| ADI-55992 | N.B. | | | 0.05 |
| ADI-55993 | N.B. | | | 0.05 |
| ADI-55994 | N.B. | | | 0.06 |
| ADI-55995 | N.B. | | | 0.04 |
| ADI-55996 | N.B. | | | 0.05 |
| ADI-55997 | N.B. | | | 0.04 |
| ADI-55998 | N.B. | | | 0.05 |
| ADI-55999 | N.B. | | | 0.05 |
| ADI-56000 | N.B. | | | 0.05 |
| ADI-56001 | N.B. | | | 0.04 |
| ADI-56002 | 1.00E-06 | | | 0.23 |
| ADI-56003 | N.B. | | | 0.05 |
| ADI-56004 | N.B. | | | 0.05 |
| ADI-56005 | N.B. | | | 0.03 |
| ADI-56006 | N.B. | | | 0.04 |
| ADI-56007 | N.B. | | | 0.04 |
| ADI-56008 | N.B. | | | 0.05 |
| ADI-56009 | N.B. | | | 0.05 |
| ADI-56010 | N.B. | | | 0.06 |
| ADI-56011 | N.B. | | | 0.06 |
| ADI-56012 | N.B. | | | 0.05 |
| ADI-56013 | N.B. | | | 0.04 |
| ADI-56014 | N.B. | | | 0.06 |
| ADI-56015 | N.B. | | | 0.06 |
| ADI-56016 | N.B. | | | 0.03 |
| ADI-56017 | N.B. | | | 0.05 |
| ADI-56018 | N.B. | | | 0.05 |
| ADI-56019 | 1.00E-06 | | | 0.15 |
| ADI-56020 | N.B. | | | 0.06 |

FIG. 8C

| ADI ID | HCoV-229E S KD [M] | HCoV-229E S kon | HCoV-229E S koff | HCoV-229E S Response |
|---|---|---|---|---|
| ADI-56021 | N.B. | | | 0.04 |
| ADI-56022 | 1.94E-09 | 1.03E+05 | 2.00E-04 | 0.32 |
| ADI-56023 | 1.00E-06 | | | 0.12 |
| ADI-56024 | N.B. | | | 0.05 |
| ADI-56025 | N.B. | | | 0.07 |
| ADI-56026 | N.B. | | | 0.05 |
| ADI-56027 | N.B. | | | 0.06 |
| ADI-56028 | 3.40E-09 | 1.04E+05 | 3.53E-04 | 0.32 |
| ADI-56029 | N.B. | | | 0.06 |
| ADI-56030 | 1.96E-09 | 1.02E+05 | 2.00E-04 | 0.27 |
| ADI-56031 | 1.01E-08 | 1.17E+05 | 1.18E-03 | 0.23 |
| ADI-56032 | N.B. | | | 0.05 |
| ADI-56033 | N.B. | | | 0.06 |
| ADI-56034 | N.B. | | | 0.06 |
| ADI-56035 | N.B. | | | 0.05 |
| ADI-56037 | 1.00E-06 | | | 0.13 |
| ADI-56038 | N.B. | | | 0.04 |
| ADI-56039 | 1.00E-06 | | | 0.11 |
| ADI-56040 | N.B. | | | 0.04 |
| ADI-56041 | N.B. | | | 0.08 |
| ADI-56042 | N.B. | | | 0.05 |
| ADI-56043 | N.B. | | | 0.04 |
| ADI-56044 | N.B. | | | 0.08 |
| ADI-56045 | N.B. | | | 0.07 |
| ADI-56046 | N.B. | | | 0.04 |
| ADI-56047 | N.B. | | | 0.03 |
| ADI-56048 | N.B. | | | 0.04 |
| ADI-56049 | 1.00E-06 | | | 0.12 |
| ADI-56050 | N.B. | | | 0.07 |
| ADI-56051 | N.B. | | | 0.02 |
| ADI-56052 | N.B. | | | 0.07 |
| ADI-56053 | N.B. | | | 0.04 |
| ADI-56054 | N.B. | | | 0.04 |
| ADI-56055 | 2.42E-09 | 8.28E+04 | 2.00E-04 | 0.21 |
| ADI-56056 | N.B. | | | 0.05 |
| ADI-56057 | 2.48E-09 | 8.07E+04 | 2.00E-04 | 0.34 |
| ADI-56058 | N.B. | | | 0.04 |
| ADI-56059 | N.B. | | | 0.04 |
| ADI-56061 | N.B. | | | 0.04 |
| ADI-56062 | N.B. | | | 0.06 |
| ADI-56063 | N.B. | | | 0.07 |
| ADI-56064 | 1.00E-06 | | | 0.13 |
| ADI-56065 | N.B. | | | 0.03 |
| ADI-56066 | N.B. | | | 0.07 |
| ADI-56067 | 1.00E-06 | | | 0.14 |
| ADI-56068 | N.B. | | | 0.03 |
| ADI-56069 | 1.00E-06 | | | 0.14 |
| ADI-56070 | N.B. | | | 0.02 |
| ADI-56071 | N.B. | | | 0.03 |
| ADI-56072 | N.B. | | | 0.02 |

FIG. 8D

| ADI ID | HCoV-229E S KD [M] | HCoV-229E S kon | HCoV-229E S koff | HCoV-229E S Response |
|---|---|---|---|---|
| ADI-56073 | N.B. | | | 0.03 |
| ADI-56074 | N.B. | | | 0.03 |
| ADI-56075 | N.B. | | | 0.02 |
| ADI-56076 | 1.00E-06 | | | 0.10 |
| ADI-56078 | N.B. | | | 0.04 |
| ADI-56079 | 1.00E-06 | | | 0.14 |
| ADI-56080 | 2.99E-09 | 1.27E+05 | 3.78E-04 | 0.18 |
| ADI-56081 | N.B. | | | 0.04 |
| ADI-56082 | N.B. | | | 0.02 |
| ADI-56083 | N.B. | | | 0.06 |
| ADI-56084 | N.B. | | | 0.07 |

FIG. 8E

| ADI ID | HKU1 S KD [M] | HKU1 S kon | HKU1 S koff | HKU1 S Response |
|---|---|---|---|---|
| ADI-55688 | N.B. | | | 0.01 |
| ADI-55689 | N.B. | | | 0.01 |
| ADI-55690 | N.B. | | | 0.01 |
| ADI-55691 | N.B. | | | 0.02 |
| ADI-55692 | | | | 0.02 |
| ADI-55693 | N.B. | | | 0.01 |
| ADI-55694 | 3.19E-08 | 1.23E+06 | 3.93E-02 | 0.56 |
| ADI-55695 | 1.00E-06 | | | 0.42 |
| ADI-55696 | NB | | | 0.01 |
| ADI-55697 | 1.00E-06 | | | 0.35 |
| ADI-55698 | N.B. | | | 0.02 |
| ADI-55699 | 1.00E-06 | | | 0.35 |
| ADI-55700 | 3.18E-08 | 1.01E+06 | 3.22E-02 | 0.35 |
| ADI-55701 | N.B. | | | 0.01 |
| ADI-55702 | 1.00E-06 | | | 0.37 |
| ADI-55703 | 1.00E-06 | | | 0.30 |
| ADI-55704 | 1.00E-06 | | | 0.36 |
| ADI-55705 | N.B. | | | 0.01 |
| ADI-55706 | N.B. | | | 0.02 |
| ADI-55707 | | | | |
| ADI-55708 | N.B. | | | 0.01 |
| ADI-55709 | N.B. | | | 0.01 |
| ADI-55710 | 1.00E-06 | | | 0.33 |
| ADI-55711 | | | | |
| ADI-55712 | | | | |
| ADI-55713 | | | | |
| ADI-55714 | 1.00E-06 | | | 0.23 |
| ADI-55715 | 1.00E-06 | | | 0.22 |
| ADI-55716 | N.B. | | | 0.01 |
| ADI-55717 | | | | 0.02 |
| ADI-55718 | N.B. | | | 0.01 |
| ADI-55719 | N.B. | | | 0.31 |
| ADI-55721 | 5.87E-08 | 5.87E+05 | 3.44E-02 | 0.25 |
| ADI-55722 | 1.00E-06 | | | 0.15 |
| ADI-55723 | 1.00E-06 | | | 0.03 |
| ADI-55724 | N.B. | | | 0.24 |
| ADI-55725 | 1.00E-06 | | | 0.15 |
| ADI-55726 | 1.00E-06 | | | 0.01 |
| ADI-55727 | N.B. | | | 0.18 |
| ADI-55728 | 1.00E-06 | | | 0.29 |
| ADI-55729 | 1.00E-06 | | | 0.02 |
| ADI-55730 | N.B. | | | 0.19 |
| ADI-55731 | 1.00E-06 | | | 0.03 |
| ADI-55732 | N.B. | | | 0.01 |
| ADI-55733 | N.B. | | | 0.01 |
| ADI-55734 | N.B. | | | 0.08 |
| ADI-55735 | N.B. | | | |
| ADI-55736 | 1.00E-06 | | | 0.19 |
| ADI-55737 | N.B. | | | 0.02 |
| ADI-55738 | | | | |

FIG. 9A

| AD ID | HKU1 S KD [M] | HKU1 S kon | HKU1 S koff | HKU1 S Response |
|---|---|---|---|---|
| AD-55739 | 1.00E-06 | | | 0.09 |
| AD-55740 | 1.77E-07 | 2.38E+05 | 4.22E-02 | 0.20 |
| AD-55741 | 1.00E-06 | | | 0.10 |
| AD-55742 | 2.11E-09 | 1.35E+05 | 2.83E-04 | 0.32 |
| AD-55743 | 1.00E-06 | | | 0.11 |
| AD-55744 | | | | |
| AD-55745 | 1.00E-06 | | | 0.07 |
| AD-55746 | N.B. | | | 0.03 |
| AD-55747 | 2.04E-09 | 1.17E+05 | 2.38E-04 | 0.27 |
| AD-55748 | 1.00E-06 | | | 0.08 |
| AD-55749 | N.B. | | | 0.00 |
| AD-55750 | 9.19E-08 | 1.50E+05 | 1.38E-02 | 0.14 |
| AD-55751 | N.B. | | | 0.02 |
| AD-55752 | N.B. | | | 0.07 |
| AD-55753 | N.B. | | | 0.07 |
| AD-55754 | N.B. | | | 0.02 |
| AD-55755 | N.B. | | | 0.01 |
| AD-55756 | 1.00E-06 | | | 0.09 |
| AD-55757 | n.d. | | | |
| AD-55758 | n.d. | | | |
| AD-55720 | | | | |
| AD-55760 | n.d. | | | |
| AD-55761 | n.d. | | | |
| AD-55762 | n.d. | | | |
| AD-55763 | n.d. | | | |
| AD-55765 | n.d. | | | |
| AD-55766 | n.d. | | | |
| AD-55767 | n.d. | | | |
| AD-55769 | n.d. | | | |
| AD-55770 | n.d. | | | |
| AD-55771 | n.d. | | | |
| AD-55775 | n.d. | | | |
| AD-55776 | n.d. | | | |
| AD-55777 | n.d. | | | |
| AD-55950 | 2.04E-08 | 1.02E+06 | 2.08E-02 | 0.64 |
| AD-55951 | N.B. | | | 0.01 |
| AD-55952 | 1.00E-06 | | | 0.22 |
| AD-55953 | 1.00E-06 | | | 0.43 |
| AD-55954 | 5.61E-09 | 1.90E+05 | 1.07E-03 | 0.34 |
| AD-55955 | N.B. | | | 0.00 |
| AD-55956 | N.B. | | | 0.00 |
| AD-55957 | 1.00E-06 | | | 0.29 |
| AD-55958 | N.B. | | | -0.01 |
| AD-55959 | 1.00E-06 | | | 0.24 |
| AD-55960 | N.B. | | | 0.02 |
| AD-55961 | 1.00E-06 | | | 0.45 |
| AD-55962 | 1.00E-06 | | | 0.14 |
| AD-55963 | N.B. | | | -0.01 |
| AD-55964 | N.B. | | | 0.01 |
| AD-55965 | 1.00E-06 | | | 0.18 |

FIG. 9B

| AD ID | HKU 1 S KD [M] | HKU 1 S kon | HKU 1 S koff | HKU 1 S Response |
|---|---|---|---|---|
| AD-55966 | 7.35E-09 | 1.01E+05 | 7.43E-04 | 0.33 |
| AD-55967 | 1.00E-06 | | | 0.18 |
| AD-55968 | 1.00E-06 | | | 0.17 |
| AD-55969 | N.B. | | | 0.02 |
| AD-55970 | 1.00E-06 | | | 0.07 |
| AD-55972 | 1.00E-06 | | | 0.23 |
| AD-55973 | N.B. | | | 0.00 |
| AD-55974 | 1.00E-06 | | | 0.32 |
| AD-55975 | 1.00E-06 | | | 0.12 |
| AD-55976 | 1.00E-06 | | | 0.52 |
| AD-55977 | N.B. | | | 0.01 |
| AD-55978 | N.B. | | | 0.01 |
| AD-55979 | N.B. | | | 0.00 |
| AD-55980 | 1.00E-06 | | | 0.38 |
| AD-55981 | 1.00E-06 | | | 0.06 |
| AD-55982 | 1.00E-06 | | | 0.20 |
| AD-55984 | 1.00E-06 | | | 0.34 |
| AD-55986 | N.B. | | | 0.02 |
| AD-55988 | N.B. | | | 0.01 |
| AD-55989 | N.B. | | | 0.01 |
| AD-55990 | 1.00E-06 | | | 0.38 |
| AD-55992 | N.B. | | | -0.01 |
| AD-55993 | N.B. | | | 0.00 |
| AD-55994 | N.B. | | | 0.02 |
| AD-55995 | N.B. | | | 0.01 |
| AD-55996 | N.B. | | | 0.01 |
| AD-55997 | N.B. | | | 0.00 |
| AD-55998 | N.B. | | | 0.01 |
| AD-55999 | N.B. | | | -0.01 |
| AD-56000 | N.B. | | | 0.00 |
| AD-56001 | N.B. | | | 0.00 |
| AD-56002 | 1.00E-06 | | | 0.15 |
| AD-56003 | N.B. | | | 0.02 |
| AD-56004 | N.B. | | | 0.01 |
| AD-56005 | N.B. | | | 0.00 |
| AD-56006 | N.B. | | | -0.01 |
| AD-56007 | N.B. | | | -0.01 |
| AD-56008 | N.B. | | | 0.00 |
| AD-56009 | N.B. | | | 0.02 |
| AD-56010 | N.B. | | | 0.00 |
| AD-56011 | N.B. | | | 0.01 |
| AD-56012 | N.B. | | | 0.00 |
| AD-56013 | N.B. | | | -0.01 |
| AD-56014 | N.B. | | | -0.01 |
| AD-56015 | 1.00E-06 | | | 0.17 |
| AD-56016 | N.B. | | | 0.02 |
| AD-56017 | N.B. | | | -0.01 |
| AD-56018 | 1.00E-06 | | | 0.04 |
| AD-56019 | 1.00E-06 | | | 0.31 |
| AD-56020 | N.B. | | | 0.01 |

FIG. 9C

| AD ID | HKU 1 S KD [M] | HKU 1 S kon | HKU 1 S koff | HKU 1 S Response |
|---|---|---|---|---|
| AD-56021 | 1.00E-06 | | | 0.05 |
| AD-56022 | 1.00E-06 | | | 0.51 |
| AD-56023 | 1.00E-06 | | | 0.17 |
| AD-56024 | N.B. | | | 0.00 |
| AD-56025 | 1.00E-06 | | | 0.15 |
| AD-56026 | N.B. | | | 0.01 |
| AD-56027 | 1.00E-06 | | | 0.27 |
| AD-56028 | 1.00E-06 | | | 0.58 |
| AD-56029 | 3.98E-09 | 1.70E+05 | 6.77E-04 | 0.34 |
| AD-56030 | 1.00E-06 | | | 0.55 |
| AD-56031 | 2.32E-08 | 1.54E+06 | 3.59E-02 | 0.48 |
| AD-56032 | N.B. | | | 0.01 |
| AD-56033 | N.B. | | | 0.01 |
| AD-56034 | N.B. | | | 0.00 |
| AD-56035 | 1.00E-06 | | | 0.48 |
| AD-56037 | 1.00E-06 | | | 0.33 |
| AD-56038 | 1.00E-06 | | | 0.10 |
| AD-56039 | N.B. | | | 0.01 |
| AD-56040 | N.B. | | | 0.07 |
| AD-56041 | N.B. | | | 0.01 |
| AD-56042 | N.B. | | | 0.01 |
| AD-56043 | N.B. | | | 0.14 |
| AD-56044 | 2.20E-07 | 2.91E+05 | 6.39E-02 | 0.25 |
| AD-56045 | 1.00E-06 | | | 0.00 |
| AD-56046 | N.B. | | | 0.00 |

| AD ID | HKU 1 S KD [M] | HKU 1 S kon | HKU 1 S koff | HKU 1 S Response |
|---|---|---|---|---|
| AD-56047 | N.B. | | | 0.01 |
| AD-56048 | N.B. | | | 0.07 |
| AD-56049 | 1.00E-06 | | | 0.40 |
| AD-56050 | 1.00E-06 | | | 0.31 |
| AD-56051 | N.B. | | | 0.02 |
| AD-56052 | 1.00E-06 | | | 0.13 |
| AD-56053 | N.B. | | | 0.00 |
| AD-56054 | N.B. | | | -0.01 |
| AD-56055 | 1.00E-06 | | | 0.54 |
| AD-56056 | 3.59E-09 | 2.23E+05 | 8.02E-04 | 0.39 |
| AD-56057 | 2.36E-08 | 1.31E+06 | 3.08E-02 | 0.32 |
| AD-56058 | N.B. | | | 0.03 |
| AD-56059 | N.B. | | | 0.02 |
| AD-56061 | 1.00E-06 | | | 0.29 |
| AD-56062 | 1.00E-06 | | | 0.21 |
| AD-56063 | 2.44E-09 | 2.48E+05 | 6.04E-04 | 0.48 |
| AD-56064 | 1.00E-06 | | | 0.37 |
| AD-56065 | N.B. | | | 0.02 |
| AD-56066 | N.B. | | | 0.02 |
| AD-56067 | 1.00E-06 | | | 0.35 |
| AD-56068 | N.B. | | | 0.03 |
| AD-56069 | 1.00E-06 | | | 0.43 |
| AD-56070 | N.B. | | | -0.01 |
| AD-56071 | N.B. | | | 0.01 |
| AD-56072 | N.B. | | | 0.06 |

FIG. 9D

| ADI ID | HKU1 S KD [M] | HKU1 S kon | HKU1 S koff | HKU1 S Response |
|---|---|---|---|---|
| ADI-56073 | N.B. | | | 0.01 |
| ADI-56074 | N.B. | | | 0.03 |
| ADI-56075 | 3.70E-09 | 1.81E+05 | 6.70E-04 | 0.40 |
| ADI-56076 | 1.00E-06 | | | 0.36 |
| ADI-56078 | N.B. | | | -0.01 |
| ADI-56079 | 1.00E-06 | | | 0.18 |
| ADI-56080 | 1.00E-06 | | | 0.19 |
| ADI-56081 | N.B. | | | 0.02 |
| ADI-56082 | N.B. | | | -0.01 |
| ADI-56083 | N.B. | | | 0.09 |
| ADI-56084 | N.B. | | | 0.08 |

FIG. 9E

| AD ID | HCoV-NL63 S KD [M] | HCoV-NL63 S kon | HCoV-NL63 S koff | HCoV-NL63 S Response |
|---|---|---|---|---|
| ADI-55688 | N.B. | | | 0.04 |
| ADI-55689 | N.B. | | | 0.03 |
| ADI-55690 | N.B. | | | 0.02 |
| ADI-55691 | N.B. | | | 0.05 |
| ADI-55692 | N.B. | | | 0.02 |
| ADI-55693 | N.B. | | | |
| ADI-55694 | N.B. | | | 0.04 |
| ADI-55695 | 1.0511E-09 | 190272.458 | 0.0002 | 0.58 |
| ADI-55696 | 1.1403E-09 | 175385.259 | 0.0002 | 0.21 |
| ADI-55697 | N.B. | | | 0.03 |
| ADI-55698 | 9.5504E-10 | 209414.543 | 0.0002 | 0.36 |
| ADI-55699 | N.B. | | | 0.03 |
| ADI-55700 | 1.5452E-09 | 129433.159 | 0.0002 | 0.27 |
| ADI-55701 | 1.00E-06 | | | 0.11 |
| ADI-55702 | | | | |
| ADI-55703 | N.B. | | | 0.05 |
| ADI-55704 | 1.2164E-09 | 164426.331 | 0.0002 | 0.29 |
| ADI-55705 | N.B. | | | 0.10 |
| ADI-55706 | 1.4359E-09 | 139287.576 | 0.0002 | 0.22 |
| ADI-55707 | N.B. | | | 0.03 |
| ADI-55708 | N.B. | | | 0.03 |
| ADI-55709 | | | | |
| ADI-55710 | N.B. | | | 0.03 |
| ADI-55711 | N.B. | | | 0.04 |
| ADI-55712 | 1.4134E-09 | 141505.829 | 0.0002 | 0.22 |
| ADI-55713 | | | | |
| ADI-55714 | 1.00E-06 | | | 0.16 |
| ADI-55715 | N.B. | | | 0.09 |
| ADI-55716 | N.B. | | | 0.03 |
| ADI-55717 | | | | |
| ADI-55718 | N.B. | | | 0.03 |
| ADI-55719 | N.B. | | | 0.02 |
| ADI-55721 | N.B. | | | 0.05 |
| ADI-55722 | 1.3762E-09 | 145325.187 | 0.0002 | 0.23 |
| ADI-55723 | N.B. | | | 0.02 |
| ADI-55724 | N.B. | | | 0.01 |
| ADI-55725 | 1.00E-06 | | | 0.16 |
| ADI-55726 | N.B. | | | 0.07 |
| ADI-55727 | N.B. | | | 0.04 |
| ADI-55728 | N.B. | | | 0.04 |
| ADI-55729 | N.B. | | | 0.07 |
| ADI-55730 | N.B. | | | 0.05 |
| ADI-55731 | N.B. | | | 0.04 |
| ADI-55732 | N.B. | | | 0.03 |
| ADI-55733 | N.B. | | | 0.04 |
| ADI-55734 | N.B. | | | 0.04 |
| ADI-55735 | N.B. | | | 0.03 |
| ADI-55736 | N.B. | | | 0.04 |
| ADI-55737 | N.B. | | | 0.04 |
| ADI-55738 | N.B. | | | 0.01 |

FIG. 10A

| ADI ID | HCoV-NL63 S KD [M] | HCoV-NL63 S kon | HCoV-NL63 S koff | HCoV-NL63 S Response |
|---|---|---|---|---|
| ADI-55739 | N.B. | | | 0.03 |
| ADI-55740 | N.B. | | | 0.09 |
| ADI-55741 | N.B. | | | 0.04 |
| ADI-55742 | N.B. | | | 0.02 |
| ADI-55743 | N.B. | | | 0.02 |
| ADI-55744 | N.B. | | | |
| ADI-55745 | N.B. | | | 0.04 |
| ADI-55746 | N.B. | | | 0.03 |
| ADI-55747 | N.B. | | | 0.04 |
| ADI-55748 | N.B. | | | 0.03 |
| ADI-55749 | N.B. | | | 0.03 |
| ADI-55750 | N.B. | | | 0.04 |
| ADI-55751 | N.B. | | | 0.04 |
| ADI-55752 | N.B. | | | 0.08 |
| ADI-55753 | N.B. | | | 0.02 |
| ADI-55754 | N.B. | | | 0.04 |
| ADI-55755 | N.B. | | | 0.03 |
| ADI-55756 | N.B. | | | 0.03 |
| ADI-55757 | n.d. | | | |
| ADI-55758 | n.d. | | | |
| ADI-55720 | n.d. | | | |
| ADI-55760 | n.d. | | | |
| ADI-55761 | n.d. | | | |
| ADI-55762 | n.d. | | | |
| ADI-55763 | n.d. | | | |

| ADI ID | HCoV-NL63 S KD [M] | HCoV-NL63 S kon | HCoV-NL63 S koff | HCoV-NL63 S Response |
|---|---|---|---|---|
| ADI-55765 | n.d. | | | |
| ADI-55766 | n.d. | | | |
| ADI-55767 | n.d. | | | |
| ADI-55769 | n.d. | | | |
| ADI-55770 | n.d. | | | |
| ADI-55771 | n.d. | | | |
| ADI-55775 | n.d. | | | |
| ADI-55776 | n.d. | | | |
| ADI-55777 | n.d. | | | |
| ADI-55950 | 1.00E-06 | | | 0.27 |
| ADI-55951 | N.B. | | | 0.05 |
| ADI-55952 | 1.00E-06 | | | 0.12 |
| ADI-55953 | 1.00E-06 | | | 0.28 |
| ADI-55954 | N.B. | | | 0.06 |
| ADI-55955 | N.B. | | | 0.05 |
| ADI-55956 | N.B. | | | 0.05 |
| ADI-55957 | N.B. | | | 0.06 |
| ADI-55958 | N.B. | | | 0.05 |
| ADI-55959 | 1.00E-06 | | | 0.21 |
| ADI-55960 | N.B. | | | 0.04 |
| ADI-55961 | 2.6664E-09 | 183811.976 | 0.00049011 | 0.39 |
| ADI-55962 | N.B. | | | 0.05 |
| ADI-55963 | N.B. | | | 0.05 |
| ADI-55964 | N.B. | | | 0.05 |
| ADI-55965 | N.B. | | | 0.07 |

FIG. 10B

| ADI ID | HCoV-NL63 S KD [M] | HCoV-NL63 S kon | HCoV-NL63 S koff | HCoV-NL63 S Response |
|---|---|---|---|---|
| ADI-55966 | N.B. | | | 0.04 |
| ADI-55967 | N.B. | | | 0.04 |
| ADI-55968 | N.B. | | | 0.05 |
| ADI-55969 | N.B. | | | 0.04 |
| ADI-55970 | N.B. | | | 0.04 |
| ADI-55972 | 1.00E-06 | | | 0.14 |
| ADI-55973 | N.B. | | | 0.03 |
| ADI-55974 | 1.00E-06 | | | 0.13 |
| ADI-55975 | N.B. | | | 0.03 |
| ADI-55976 | 3.3606E-09 | 140600.607 | 0.0004725 | 0.36 |
| ADI-55977 | N.B. | | | 0.02 |
| ADI-55978 | N.B. | | | 0.04 |
| ADI-55979 | N.B. | | | 0.03 |
| ADI-55980 | 1.00E-06 | | | 0.21 |
| ADI-55981 | N.B. | | | 0.06 |
| ADI-55982 | N.B. | | | 0.05 |
| ADI-55984 | 1.00E-06 | | | 0.22 |
| ADI-55986 | N.B. | | | 0.06 |
| ADI-55988 | N.B. | | | 0.06 |
| ADI-55989 | N.B. | | | 0.04 |
| ADI-55990 | 1.00E-06 | | | 0.27 |
| ADI-55992 | N.B. | | | 0.05 |
| ADI-55993 | N.B. | | | 0.06 |
| ADI-55994 | N.B. | | | 0.04 |
| ADI-55995 | N.B. | | | 0.06 |
| ADI-55996 | N.B. | | | 0.05 |
| ADI-55997 | N.B. | | | 0.03 |
| ADI-55998 | N.B. | | | 0.04 |
| ADI-55999 | N.B. | | | 0.04 |
| ADI-56000 | N.B. | | | 0.05 |
| ADI-56001 | N.B. | | | 0.04 |
| ADI-56002 | 1.00E-06 | | | 0.15 |
| ADI-56003 | N.B. | | | 0.06 |
| ADI-56004 | N.B. | | | 0.05 |
| ADI-56005 | N.B. | | | 0.04 |
| ADI-56006 | N.B. | | | 0.03 |
| ADI-56007 | N.B. | | | 0.02 |
| ADI-56008 | N.B. | | | 0.03 |
| ADI-56009 | N.B. | | | 0.05 |
| ADI-56010 | N.B. | | | 0.06 |
| ADI-56011 | N.B. | | | 0.05 |
| ADI-56012 | N.B. | | | 0.04 |
| ADI-56013 | N.B. | | | 0.06 |
| ADI-56014 | N.B. | | | 0.04 |
| ADI-56015 | N.B. | | | 0.05 |
| ADI-56016 | N.B. | | | 0.05 |
| ADI-56017 | N.B. | | | 0.06 |
| ADI-56018 | N.B. | | | 0.04 |
| ADI-56019 | N.B. | | | 0.08 |
| ADI-56020 | N.B. | | | 0.05 |

FIG. 10C

| ADI ID | HCoV-NL63 S KD [M] | HCoV-NL63 S kon | HCoV-NL63 S koff | HCoV-NL63 S Response |
|---|---|---|---|---|
| ADI-56021 | N.B. | | | 0.08 |
| ADI-56022 | 3.9773E-09 | 156117.689 | 0.00062092 | 0.36 |
| ADI-56023 | N.B. | | | 0.08 |
| ADI-56024 | N.B. | | | 0.04 |
| ADI-56025 | N.B. | | | 0.05 |
| ADI-56026 | N.B. | | | 0.05 |
| ADI-56027 | N.B. | | | 0.09 |
| ADI-56028 | 2.2256E-09 | 163507.783 | 0.00036391 | 0.45 |
| ADI-56029 | N.B. | | | 0.08 |
| ADI-56030 | 1.2926E-09 | 156979.446 | 0.0002029 | 0.40 |
| ADI-56031 | 3.5602E-09 | 151870.463 | 0.0005407 | 0.39 |
| ADI-56032 | N.B. | | | 0.03 |
| ADI-56033 | N.B. | | | 0.04 |
| ADI-56034 | N.B. | | | 0.06 |
| ADI-56035 | N.B. | | | 0.06 |
| ADI-56037 | N.B. | | | 0.09 |
| ADI-56038 | 1.00E-06 | | | 0.22 |
| ADI-56039 | N.B. | | | 0.05 |
| ADI-56040 | N.B. | | | 0.04 |
| ADI-56041 | N.B. | | | 0.04 |
| ADI-56042 | N.B. | | | 0.05 |
| ADI-56043 | N.B. | | | 0.05 |
| ADI-56044 | N.B. | | | 0.07 |
| ADI-56045 | 1.00E-06 | | | 0.12 |
| ADI-56046 | N.B. | | | 0.04 |
| ADI-56047 | N.B. | | | 0.05 |
| ADI-56048 | N.B. | | | 0.04 |
| ADI-56049 | 1.00E-06 | | | 0.26 |
| ADI-56050 | 1.00E-06 | | | 0.16 |
| ADI-56051 | N.B. | | | 0.03 |
| ADI-56052 | N.B. | | | 0.06 |
| ADI-56053 | N.B. | | | 0.05 |
| ADI-56054 | N.B. | | | 0.03 |
| ADI-56055 | 1.00E-06 | | | 0.34 |
| ADI-56056 | N.B. | | | 0.04 |
| ADI-56057 | 1.5304E-09 | 151660.386 | 0.0002321 | 0.40 |
| ADI-56058 | N.B. | | | 0.04 |
| ADI-56059 | N.B. | | | 0.03 |
| ADI-56061 | N.B. | | | 0.08 |
| ADI-56062 | N.B. | | | 0.06 |
| ADI-56063 | N.B. | | | 0.08 |
| ADI-56064 | N.B. | | | 0.23 |
| ADI-56065 | 1.00E-06 | | | 0.03 |
| ADI-56066 | N.B. | | | 0.03 |
| ADI-56067 | 1.21E-09 | 165291.095 | 0.0002 | 0.30 |
| ADI-56068 | N.B. | | | 0.03 |
| ADI-56069 | 1.9024E-09 | 105127.626 | 0.0002 | 0.28 |
| ADI-56070 | N.B. | | | 0.03 |
| ADI-56071 | N.B. | | | 0.03 |
| ADI-56072 | N.B. | | | 0.04 |

FIG. 10D

| ADI ID | HCoV-NL63 S KD [M] | HCoV-NL63 S kon | HCoV-NL63 S koff | HCoV-NL63 S Response |
|---|---|---|---|---|
| ADI-56073 | N.B. | | | 0.04 |
| ADI-56074 | N.B. | | | 0.04 |
| ADI-56075 | N.B. | | | 0.05 |
| ADI-56076 | 1.00E-06 | | | 0.16 |
| ADI-56078 | N.B. | | | 0.05 |
| ADI-56079 | 1.00E-06 | | | 0.13 |
| ADI-56080 | 1.00E-06 | | | 0.16 |
| ADI-56081 | N.B. | | | 0.04 |
| ADI-56082 | N.B. | | | 0.06 |
| ADI-56083 | N.B. | | | 0.04 |
| ADI-56084 | N.B. | | | 0.03 |

FIG. 10E

| ADI ID | HCoV-OC43 S KD [M] | HCoV-OC43 S kon | HCoV-OC43 S koff | HCoV-OC43 S Response |
|---|---|---|---|---|
| AD-55688 | N.B. | | | 0.01 |
| AD-55689 | N.B. | | | 0.01 |
| AD-55690 | N.B. | | | 0.02 |
| AD-55691 | N.B. | | | 0.01 |
| AD-55692 | N.B. | | | 0.02 |
| AD-55693 | | | | |
| AD-55694 | N.B. | | | 0.02 |
| AD-55695 | N.B. | | | 0.06 |
| AD-55696 | N.B. | | | 0.04 |
| AD-55697 | N.B. | | | 0.02 |
| AD-55698 | N.B. | | | 0.01 |
| AD-55699 | N.B. | | | 0.02 |
| AD-55700 | N.B. | | | 0.03 |
| AD-55701 | N.B. | | | 0.01 |
| AD-55702 | | | | |
| AD-55703 | N.B. | | | 0.01 |
| AD-55704 | N.B. | | | 0.05 |
| AD-55705 | N.B. | | | 0.03 |
| AD-55706 | N.B. | | | 0.06 |
| AD-55707 | N.B. | | | 0.01 |
| AD-55708 | N.B. | | | 0.02 |
| AD-55709 | | | | |
| AD-55710 | N.B. | | | 0.00 |
| AD-55711 | N.B. | | | 0.01 |
| AD-55712 | N.B. | | | 0.00 |

| ADI ID | HCoV-OC43 S KD [M] | HCoV-OC43 S kon | HCoV-OC43 S koff | HCoV-OC43 S Response |
|---|---|---|---|---|
| AD-55713 | | | | |
| AD-55714 | N.B. | | | 0.01 |
| AD-55715 | N.B. | | | 0.01 |
| AD-55716 | N.B. | | | 0.02 |
| AD-55717 | | | | |
| AD-55718 | N.B. | | | 0.01 |
| AD-55719 | N.B. | | | 0.02 |
| AD-55721 | N.B. | | | 0.01 |
| AD-55722 | N.B. | | | 0.01 |
| AD-55723 | N.B. | | | 0.01 |
| AD-55724 | 2.963E-09 | 67498.7445 | 0.0002 | 0.18 |
| AD-55725 | N.B. | | | 0.02 |
| AD-55726 | N.B. | | | 0.02 |
| AD-55727 | N.B. | | | 0.02 |
| AD-55728 | N.B. | | | 0.01 |
| AD-55729 | N.B. | | | 0.00 |
| AD-55730 | N.B. | | | 0.01 |
| AD-55731 | N.B. | | | 0.02 |
| AD-55732 | 3.1773E-09 | 62945.8347 | 0.0002 | 0.16 |
| AD-55733 | N.B. | | | 0.02 |
| AD-55734 | N.B. | | | 0.00 |
| AD-55735 | N.B. | | | 0.01 |
| AD-55736 | N.B. | | | 0.01 |
| AD-55737 | N.B. | | | 0.01 |
| AD-55738 | | | | |

FIG. 11A

| ADI ID | HCoV-OC43 S KD [M] | HCoV-OC43 S kon | HCoV-OC43 S koff | HCoV-OC43 S Response |
|---|---|---|---|---|
| ADI-55739 | N.B. | | | 0.02 |
| ADI-55740 | N.B. | | | 0.03 |
| ADI-55741 | N.B. | | | 0.00 |
| ADI-55742 | N.B. | | | 0.02 |
| ADI-55743 | N.B. | | | 0.03 |
| ADI-55744 | | | | |
| ADI-55745 | N.B. | | | 0.00 |
| ADI-55746 | N.B. | | | 0.02 |
| ADI-55747 | N.B. | | | 0.02 |
| ADI-55748 | N.B. | | | 0.02 |
| ADI-55749 | N.B. | | | 0.00 |
| ADI-55750 | N.B. | | | 0.01 |
| ADI-55751 | N.B. | | | 0.01 |
| ADI-55752 | N.B. | | | 0.01 |
| ADI-55753 | N.B. | | | 0.01 |
| ADI-55754 | N.B. | | | 0.01 |
| ADI-55755 | N.B. | | | 0.02 |
| ADI-55756 | N.B. | | | 0.02 |
| ADI-55757 | n.d. | | | |
| ADI-55758 | n.d. | | | |
| ADI-55720 | | | | |
| ADI-55760 | n.d. | | | |
| ADI-55761 | n.d. | | | |
| ADI-55762 | n.d. | | | |
| ADI-55763 | n.d. | | | |
| ADI-55765 | n.d. | | | |
| ADI-55766 | n.d. | | | |
| ADI-55767 | n.d. | | | |
| ADI-55769 | n.d. | | | |
| ADI-55770 | n.d. | | | |
| ADI-55771 | n.d. | | | |
| ADI-55775 | n.d. | | | |
| ADI-55776 | n.d. | | | |
| ADI-55777 | n.d. | | | |
| ADI-55950 | N.B. | | | 0.02 |
| ADI-55951 | N.B. | | | 0.00 |
| ADI-55952 | N.B. | | | 0.01 |
| ADI-55953 | N.B. | | | 0.01 |
| ADI-55954 | N.B. | | | 0.01 |
| ADI-55955 | N.B. | | | 0.01 |
| ADI-55956 | N.B. | | | 0.00 |
| ADI-55957 | N.B. | | | 0.01 |
| ADI-55958 | N.B. | | | 0.02 |
| ADI-55959 | N.B. | | | 0.03 |
| ADI-55960 | N.B. | | | 0.02 |
| ADI-55961 | N.B. | | | 0.03 |
| ADI-55962 | N.B. | | | 0.01 |
| ADI-55963 | N.B. | | | 0.01 |
| ADI-55964 | N.B. | | | 0.02 |
| ADI-55965 | N.B. | | | 0.01 |

FIG. 11B

| ADI ID | HCoV-OC43 S KD [M] | HCoV-OC43 S kon | HCoV-OC43 S koff | HCoV-OC43 S Response |
|---|---|---|---|---|
| ADI-55966 | N.B. | | | 0.02 |
| ADI-55967 | N.B. | | | 0.03 |
| ADI-55968 | N.B. | | | 0.03 |
| ADI-55969 | N.B. | | | 0.01 |
| ADI-55970 | N.B. | | | 0.02 |
| ADI-55972 | N.B. | | | 0.02 |
| ADI-55973 | N.B. | | | 0.01 |
| ADI-55974 | N.B. | | | 0.00 |
| ADI-55975 | N.B. | | | 0.01 |
| ADI-55976 | N.B. | | | 0.05 |
| ADI-55977 | N.B. | | | 0.01 |
| ADI-55978 | N.B. | | | 0.03 |
| ADI-55979 | N.B. | | | 0.02 |
| ADI-55980 | N.B. | | | 0.02 |
| ADI-55981 | N.B. | | | 0.01 |
| ADI-55982 | N.B. | | | 0.02 |
| ADI-55984 | N.B. | | | 0.02 |
| ADI-55986 | N.B. | | | 0.02 |
| ADI-55988 | N.B. | | | 0.00 |
| ADI-55989 | N.B. | | | 0.01 |
| ADI-55990 | N.B. | | | 0.03 |
| ADI-55992 | N.B. | | | 0.03 |
| ADI-55993 | N.B. | | | 0.03 |
| ADI-55994 | N.B. | | | 0.03 |
| ADI-55995 | N.B. | | | 0.02 |
| ADI-55996 | N.B. | | | 0.03 |
| ADI-55997 | N.B. | | | 0.02 |
| ADI-55998 | N.B. | | | 0.02 |
| ADI-55999 | N.B. | | | 0.02 |
| ADI-56000 | N.B. | | | 0.01 |
| ADI-56001 | N.B. | | | 0.03 |
| ADI-56002 | N.B. | | | 0.03 |
| ADI-56003 | N.B. | | | 0.03 |
|

| ADI ID | HCoV-OC43 S KD [M] | HCoV-OC43 S kon | HCoV-OC43 S koff | HCoV-OC43 S Response |
|---|---|---|---|---|
| ADI-56021 | N.B. | | | 0.01 |
| ADI-56022 | N.B. | | | 0.02 |
| ADI-56023 | N.B. | | | 0.03 |
| ADI-56024 | N.B. | | | 0.03 |
| ADI-56025 | N.B. | | | 0.02 |
| ADI-56026 | N.B. | | | 0.04 |
| ADI-56027 | N.B. | | | 0.02 |
| ADI-56028 | N.B. | | | 0.07 |
| ADI-56029 | N.B. | | | 0.02 |
| ADI-56030 | N.B. | | | 0.07 |
| ADI-56031 | N.B. | | | 0.03 |
| ADI-56032 | N.B. | | | 0.03 |
| ADI-56033 | N.B. | | | 0.03 |
| ADI-56034 | N.B. | | | 0.04 |
| ADI-56035 | N.B. | | | 0.01 |
| ADI-56037 | N.B. | | | 0.01 |
| ADI-56038 | N.B. | | | 0.02 |
| ADI-56039 | N.B. | | | 0.01 |
| ADI-56040 | N.B. | | | 0.01 |
| ADI-56041 | N.B. | | | 0.03 |
| ADI-56042 | N.B. | | | 0.03 |
| ADI-56043 | N.B. | | | 0.02 |
| ADI-56044 | N.B. | | | 0.04 |
| ADI-56045 | N.B. | | | 0.02 |
| ADI-56046 | N.B. | | | 0.02 |
| ADI-56047 | N.B. | | | 0.02 |
| ADI-56048 | N.B. | | | 0.02 |
| ADI-56049 | N.B. | | | 0.03 |
| ADI-56050 | N.B. | | | 0.03 |
| ADI-56051 | N.B. | | | 0.03 |
| ADI-56052 | N.B. | | | 0.03 |
| ADI-56053 | N.B. | | | 0.04 |
| ADI-56054 | N.B. | | | 0.02 |
| ADI-56055 | 1.00E-06 | | | 0.10 |
| ADI-56056 | N.B. | | | 0.02 |
| ADI-56057 | N.B. | | | 0.00 |
| ADI-56058 | N.B. | | | 0.01 |
| ADI-56059 | N.B. | | | 0.01 |
| ADI-56061 | N.B. | | | 0.00 |
| ADI-56062 | N.B. | | | 0.02 |
| ADI-56063 | N.B. | | | 0.01 |
| ADI-56064 | N.B. | | | 0.00 |
| ADI-56065 | N.B. | | | 0.02 |
| ADI-56066 | N.B. | | | 0.02 |
| ADI-56067 | N.B. | | | 0.04 |
| ADI-56068 | N.B. | | | 0.02 |
| ADI-56069 | N.B. | | | 0.02 |
| ADI-56070 | N.B. | | | 0.00 |
| ADI-56071 | N.B. | | | 0.01 |
| ADI-56072 | N.B. | | | 0.02 |

FIG. 11D

| ADI ID | HCoV-OC43 S KD [M] | HCoV-OC43 S kon | HCoV-OC43 S koff | HCoV-OC43 S Response |
|---|---|---|---|---|
| ADI-56073 | N.B. | | | 0.02 |
| ADI-56074 | N.B. | | | 0.02 |
| ADI-56075 | N.B. | | | 0.02 |
| ADI-56076 | N.B. | | | 0.03 |
| ADI-56078 | N.B. | | | 0.02 |
| ADI-56079 | N.B. | | | 0.02 |
| ADI-56080 | N.B. | | | 0.02 |
| ADI-56081 | N.B. | | | 0.01 |
| ADI-56082 | N.B. | | | 0.01 |
| ADI-56083 | N.B. | | | 0.03 |
| ADI-56084 | N.B. | | | 0.03 |

FI

| ADI ID | Broad cross-reactivity with 1 or more circulating CoVs | SARS-CoV S binder? | SARS-CoV-2 S binder? | HCoV-229E S binder? | HKU1 S binder? | NL63 S binder? | OK43 S binder? |
|---|---|---|---|---|---|---|---|
| ADI-55688 | SARS1-2 specific | Yes | Yes | No | No | No | No |
| ADI-55689 | SARS1-2 specific | Yes | Yes | No | No | No | No |
| ADI-55690 | SARS1-2 specific | Yes | Yes | No | No | No | No |
| ADI-55691 | SARS1-2 specific | Yes | Yes | No | No | No | No |
| ADI-55692 | SARS1-2 specific | Yes | Yes | No | No | No | No |
| ADI-55693 | | | | | | | |
| ADI-55694 | SARS1-2 specific | Yes | Yes | No | No | No | No |
| ADI-55695 | Broad | Yes | Yes | Yes | Yes | Yes | No |
| ADI-55696 | Broad | Yes | Yes | Yes | Yes | Yes | No |
| ADI-55697 | SARS1-2 specific | Yes | Yes | No | No | No | No |
| ADI-55698 | Broad | Yes | Yes | Yes | Yes | Yes | No |
| ADI-55699 | SARS1-2 specific | Yes | Yes | No | No | No | No |
| ADI-55700 | Broad | Yes | Yes | Yes | Yes | Yes | No |
| ADI-55701 | Broad | Yes | Yes | Yes | Yes | Yes | No |
| ADI-55702 | | | | | | | |
| ADI-55703 | SARS1-2 specific | Yes | Yes | No | No | No | No |
| ADI-55704 | Broad | Yes | Yes | Yes | Yes | Yes | No |
| ADI-55705 | Broad | Yes | Yes | Yes | Yes | No | No |
| ADI-55706 | Broad | Yes | Yes | Yes | Yes | Yes | No |
| ADI-55707 | SARS1-2 specific | Yes | Yes | No | No | No | No |
| ADI-55708 | SARS1-2 specific | Yes | Yes | No | No | No | No |
| ADI-55709 | | | | | | | |
| ADI-55710 | SARS1-2 specific | Yes | Yes | No | No | No | No |
| ADI-55711 | SARS1-2 specific | Yes | Yes | No | No | No | No |
| ADI-55712 | Broad | Yes | Yes | Yes | Yes | Yes | No |

FIG. 12A

| ADI ID | Broad cross-reactivity with 1 or more circulating CoVs | SARS-CoV S binder? | SARS-CoV-2 S binder? | HCoV-229E S binder? | HKU1 S binder? | NL63 S binder? | OK43 S binder? |
|---|---|---|---|---|---|---|---|
| ADI-55713 | | | | | | | |
| ADI-55714 | Broad | Yes | Yes | Yes | Yes | Yes | No |
| ADI-55715 | Broad | Yes | Yes | Yes | Yes | No | No |
| ADI-55716 | SARS1-2 specific | Yes | Yes | No | No | No | No |
| ADI-55717 | | | | | | | |
| ADI-55718 | SARS1-2 specific | Yes | Yes | No | No | No | No |
| ADI-55719 | SARS1-2 specific | Yes | Yes | No | No | No | No |
| ADI-55721 | Broad | Yes | Yes | No | Yes | No | No |
| ADI-55722 | Broad | Yes | Yes | Yes | Yes | Yes | No |
| ADI-55723 | Broad | Yes | Yes | No | Yes | No | No |
| ADI-55724 | Broad | Yes | Yes | No | No | No | Yes |
| ADI-55725 | Broad | Yes | Yes | Yes | Yes | Yes | No |
| ADI-55726 | Broad | Yes | Yes | No | Yes | No | No |
| ADI-55727 | SARS1-2 specific | Yes | Yes | No | No | No | No |
| ADI-55728 | Broad | Yes | Yes | No | Yes | No | No |
| ADI-55729 | Broad | Yes | Yes | No | Yes | No | No |
| ADI-55730 | SARS1-2 specific | Yes | Yes | No | No | No | No |
| ADI-55731 | Broad | Yes | Yes | No | Yes | No | No |
| ADI-55732 | Broad | Yes | Yes | No | No | No | Yes |
| ADI-55733 | | Yes | No | No | No | No | No |
| ADI-55734 | SARS1-2 specific | Yes | Yes | No | No | No | No |
| ADI-55735 | SARS1-2 specific | Yes | Yes | No | No | No | No |
| ADI-55736 | Broad | Yes | Yes | No | Yes | No | No |
| ADI-55737 | SARS1-2 specific | Yes | Yes | No | No | No | No |
| ADI-55738 | | | | | | | |

FIG. 12B

| ADI ID | Broad cross-reactivity with 1 or more circulating CoVs | SARS-CoV S binder? | SARS-CoV-2 S binder? | HCoV-229E S binder? | HKU1 S binder? | NL63 S binder? | OK43 S binder? |
|---|---|---|---|---|---|---|---|
| ADI-55739 | Broad | Yes | Yes | No | Yes | No | No |
| ADI-55740 | Broad | Yes | Yes | No | Yes | No | No |
| ADI-55741 | Broad | Yes | Yes | No | Yes | No | No |
| ADI-55742 | Broad | Yes | Yes | No | Yes | No | No |
| ADI-55743 | Broad | Yes | Yes | No | Yes | No | No |
| ADI-55744 | | | | | | | |
| ADI-55745 | Broad | Yes | Yes | No | Yes | No | No |
| ADI-55746 | SARS1-2 specific | Yes | Yes | No | No | No | No |
| ADI-55747 | Broad | Yes | Yes | No | Yes | No | No |
| ADI-55748 | Broad | Yes | Yes | No | Yes | No | No |
| ADI-55749 | SARS1-2 specific | Yes | Yes | No | No | No | No |
| ADI-55750 | Broad | Yes | Yes | No | Yes | No | No |
| ADI-55751 | SARS1-2 specific | Yes | Yes | No | No | No | No |
| ADI-55752 | Broad | Yes | Yes | Yes | No | No | No |
| ADI-55753 | | Yes | No | No | No | No | No |
| ADI-55754 | SARS1-2 specific | Yes | Yes | No | No | No | No |
| ADI-55755 | SARS1-2 specific | Yes | Yes | No | No | No | No |
| ADI-55756 | SARS1-2 specific | Yes | Yes | No | Yes | No | No |
| ADI-55757 | SARS1-2 specific | Yes | Yes | No | No | No | No |
| ADI-55758 | SARS1-2 specific | No | Yes | No | No | No | No |
| ADI-55720 | | | | | | | |
| ADI-55760 | SARS1-2 specific | No | Yes | No | No | No | No |
| ADI-55761 | SARS1-2 specific | No | Yes | No | No | No | No |
| ADI-55762 | SARS1-2 specific | No | Yes | No | No | No | No |
| ADI-55763 | SARS1-2 specific | No | Yes | No | No | No | No |

FIG. 12C

| ADI ID | Broad cross-reactivity with 1 or more circulating CoVs | SARS-CoV S binder? | SARS-CoV-2 S binder? | HCoV-229E S binder? | HKU1 S binder? | NL63 S binder? | OK43 S binder? |
|---|---|---|---|---|---|---|---|
| ADI-55765 | SARS1-2 specific | No | Yes | No | No | No | No |
| ADI-55766 | SARS1-2 specific | No | Yes | No | No | No | No |
| ADI-55767 | SARS1-2 specific | No | Yes | No | No | No | No |
| ADI-55769 | SARS1-2 specific | No | Yes | No | No | No | No |
| ADI-55770 | SARS1-2 specific | No | Yes | No | No | No | No |
| ADI-55771 | SARS1-2 specific | No | Yes | No | No | No | No |
| ADI-55775 | SARS1-2 specific | No | Yes | No | No | No | No |
| ADI-55776 | SARS1-2 specific | No | Yes | No | No | No | No |
| ADI-55777 | SARS1-2 specific | No | Yes | No | No | No | No |
| ADI-55950 | Broad | Yes | Yes | Yes | Yes | Yes | No |
| ADI-55951 | SARS1-2 specific | Yes | Yes | No | No | No | No |
| ADI-55952 | Broad | Yes | Yes | No | Yes | Yes | No |
| ADI-55953 | Broad | Yes | Yes | Yes | Yes | Yes | No |
| ADI-55954 | Broad | Yes | Yes | No | Yes | No | No |
| ADI-55955 | SARS1-2 specific | Yes | Yes | No | No | No | No |
| ADI-55956 | SARS1-2 specific | Yes | Yes | No | No | No | No |
| ADI-55957 | Broad | Yes | Yes | No | Yes | No | No |
| ADI-55958 | SARS1-2 specific | Yes | Yes | No | No | No | No |
| ADI-55959 | Broad | Yes | Yes | Yes | Yes | Yes | No |
| ADI-55960 | SARS1-2 specific | Yes | Yes | No | No | No | No |
| ADI-55961 | Broad | Yes | Yes | Yes | Yes | Yes | No |
| ADI-55962 | Broad | Yes | Yes | No | Yes | No | No |
| ADI-55963 | SARS1-2 specific | No | Yes | No | No | No | No |
| ADI-55964 | SARS1-2 specific | Yes | Yes | No | No | No | No |
| ADI-55965 | Broad | Yes | Yes | Yes | Yes | No | No |

FIG. 12D

| ADI ID | Broad cross-reactivity with 1 or more circulating CoVs | SARS-CoV S binder? | SARS-CoV-2 S binder? | HCoV-229E S binder? | HKU1 S binder? | NL63 S binder? | OK43 S binder? |
|---|---|---|---|---|---|---|---|
| ADI-55966 | Broad | Yes | Yes | No | Yes | No | No |
| ADI-55967 | Broad | Yes | Yes | No | Yes | No | No |
| ADI-55968 | Broad | Yes | Yes | No | Yes | No | No |
| ADI-55969 | SARS1-2 specific | Yes | Yes | No | No | No | No |
| ADI-55970 | Broad | No | Yes | No | Yes | No | No |
| ADI-55972 | Broad | Yes | Yes | Yes | Yes | Yes | No |
| ADI-55973 | SARS1-2 specific | Yes | Yes | No | No | No | No |
| ADI-55974 | Broad | Yes | Yes | Yes | Yes | Yes | No |
| ADI-55975 | Broad | Yes | Yes | No | Yes | No | No |
| ADI-55976 | Broad | Yes | Yes | Yes | Yes | Yes | No |
| ADI-55977 | SARS1-2 specific | Yes | Yes | No | No | No | No |
| ADI-55978 | SARS1-2 specific | Yes | Yes | No | No | No | No |
| ADI-55979 | SARS1-2 specific | No | Yes | No | No | No | No |
| ADI-55980 | Broad | Yes | Yes | Yes | Yes | Yes | No |
| ADI-55981 | Broad | No | Yes | No | Yes | No | No |
| ADI-55982 | Broad | Yes | Yes | No | Yes | No | No |
| ADI-55984 | Broad | Yes | Yes | Yes | Yes | Yes | No |
| ADI-55986 | SARS1-2 specific | No | Yes | No | No | No | No |
| ADI-55988 | SARS1-2 specific | Yes | Yes | No | No | No | No |
| ADI-55989 | SARS1-2 specific | Yes | Yes | No | No | No | No |
| ADI-55990 | Broad | Yes | Yes | Yes | Yes | Yes | No |
| ADI-55992 | SARS1-2 specific | No | Yes | No | No | No | No |
| ADI-55993 | SARS1-2 specific | Yes | Yes | No | No | No | No |
| ADI-55994 | SARS1-2 specific | Yes | Yes | No | No | No | No |
| ADI-55995 | SARS1-2 specific | No | Yes | No | No | No | No |

FIG. 12E

| ADI ID | Broad cross-reactivity with 1 or more circulating CoVs | SARS-CoV S binder? | SARS-CoV-2 S binder? | HCoV-229E S binder? | HKU1 S binder? | NL63 S binder? | OK43 S binder? |
|---|---|---|---|---|---|---|---|
| ADI-55996 | SARS1-2 specific | No | Yes | No | No | No | No |
| ADI-55997 | SARS1-2 specific | No | Yes | No | No | No | No |
| ADI-55998 | SARS1-2 specific | No | Yes | No | No | No | No |
| ADI-55999 | SARS1-2 specific | No | Yes | No | No | No | No |
| ADI-56000 | SARS1-2 specific | Yes | Yes | No | No | No | No |
| ADI-56001 | SARS1-2 specific | No | Yes | No | No | No | No |
| ADI-56002 | Broad | Yes | Yes | Yes | Yes | Yes | No |
| ADI-56003 | SARS1-2 specific | No | Yes | No | No | No | No |
| ADI-56004 | SARS1-2 specific | Yes | Yes | No | No | No | No |
| ADI-56005 | SARS1-2 specific | Yes | Yes | No | No | No | No |
| ADI-56006 | SARS1-2 specific | No | Yes | No | No | No | No |
| ADI-56007 | SARS1-2 specific | Yes | Yes | No | No | No | No |
| ADI-56008 | SARS1-2 specific | Yes | Yes | No | No | No | No |
| ADI-56009 | SARS1-2 specific | No | Yes | No | No | No | No |
| ADI-56010 | SARS1-2 specific | Yes | Yes | No | No | No | No |
| ADI-56011 | SARS1-2 specific | Yes | Yes | No | No | No | No |
| ADI-56012 | SARS1-2 specific | No | Yes | No | No | No | No |
| ADI-56013 | SARS1-2 specific | No | Yes | No | No | No | No |
| ADI-56014 | SARS1-2 specific | No | Yes | No | No | No | No |
| ADI-56015 | Broad | Yes | Yes | No | Yes | No | No |
| ADI-56016 | SARS1-2 specific | Yes | Yes | No | No | No | No |
| ADI-56017 | SARS1-2 specific | Yes | Yes | No | No | No | No |
| ADI-56018 | Broad | No | Yes | No | Yes | No | No |
| ADI-56019 | Broad | Yes | Yes | Yes | Yes | No | No |
| ADI-56020 | SARS1-2 specific | No | Yes | No | No | No | No |

FIG. 12F

| ADI ID | Broad cross-reactivity with 1 or more circulating CoVs | SARS-CoV S binder? | SARS-CoV-2 S binder? | HCoV-229E S binder? | HKU1 S binder? | NL63 S binder? | OK43 S binder? |
|---|---|---|---|---|---|---|---|
| ADI-56021 | Broad | No | Yes | No | Yes | No | No |
| ADI-56022 | Broad | Yes | Yes | Yes | Yes | Yes | No |
| ADI-56023 | Broad | Yes | Yes | Yes | Yes | No | No |
| ADI-56024 | SARS1-2 specific | Yes | Yes | No | No | No | No |
| ADI-56025 | Broad | Yes | Yes | No | Yes | No | No |
| ADI-56026 | SARS1-2 specific | Yes | Yes | No | No | No | No |
| ADI-56027 | Broad | Yes | Yes | No | Yes | No | No |
| ADI-56028 | Broad | Yes | Yes | Yes | Yes | Yes | No |
| ADI-56029 | Broad | Yes | Yes | No | Yes | No | No |
| ADI-56030 | Broad | Yes | Yes | Yes | Yes | Yes | No |
| ADI-56031 | Broad | Yes | Yes | Yes | Yes | Yes | No |
| ADI-56032 | SARS1-2 specific | Yes | Yes | No | No | No | No |
| ADI-56033 | SARS1-2 specific | No | Yes | No | No | No | No |
| ADI-56034 | SARS1-2 specific | No | Yes | No | No | No | No |
| ADI-56035 | SARS1-2 specific | Yes | Yes | No | No | No | No |
| ADI-56037 | Broad | Yes | Yes | Yes | Yes | No | No |
| ADI-56038 | Broad | Yes | Yes | No | Yes | Yes | No |
| ADI-56039 | Broad | No | Yes | Yes | Yes | No | No |
| ADI-56040 | SARS1-2 specific | Yes | Yes | No | No | No | No |
| ADI-56041 | SARS1-2 specific | No | Yes | No | No | No | No |
| ADI-56042 | SARS1-2 specific | No | Yes | No | No | No | No |
| ADI-56043 | SARS1-2 specific | Yes | Yes | No | No | No | No |
| ADI-56044 | Broad | Yes | Yes | No | Yes | No | No |
| ADI-56045 | Broad | Yes | Yes | No | Yes | Yes | No |
| ADI-56046 | SARS1-2 specific | Yes | Yes | No | No | No | No |

FIG. 12G

| ADI ID | Broad cross-reactivity with 1 or more circulating CoVs | SARS-CoV S binder? | SARS-CoV-2 S binder? | HCoV-229E S binder? | HKU1 S binder? | NL63 S binder? | OK43 S binder? |
|---|---|---|---|---|---|---|---|
| ADI-56047 | SARS1-2 specific | No | Yes | No | No | No | No |
| ADI-56048 | SARS1-2 specific | No | Yes | No | No | No | No |
| ADI-56049 | Broad | Yes | Yes | Yes | Yes | Yes | No |
| ADI-56050 | Broad | Yes | Yes | No | Yes | Yes | No |
| ADI-56051 | SARS1-2 specific | Yes | Yes | No | No | No | No |
| ADI-56052 | Broad | Yes | Yes | No | Yes | No | No |
| ADI-56053 | SARS1-2 specific | No | Yes | No | No | No | No |
| ADI-56054 | SARS1-2 specific | Yes | Yes | No | No | No | No |
| ADI-56055 | Broad | Yes | Yes | Yes | Yes | Yes | Yes |
| ADI-56056 | Broad | Yes | Yes | No | Yes | No | No |
| ADI-56057 | Broad | Yes | Yes | Yes | Yes | Yes | No |
| ADI-56058 | SARS1-2 specific | Yes | Yes | No | No | No | No |
| ADI-56059 | SARS1-2 specific | Yes | Yes | No | No | No | No |
| ADI-56061 | Broad | Yes | Yes | No | Yes | No | No |
| ADI-56062 | Broad | Yes | Yes | No | Yes | No | No |
| ADI-56063 | Broad | Yes | Yes | No | Yes | No | No |
| ADI-56064 | Broad | Yes | Yes | Yes | Yes | Yes | No |
| ADI-56065 | SARS1-2 specific | No | Yes | No | No | No | No |
| ADI-56066 | SARS1-2 specific | No | Yes | No | No | No | No |
| ADI-56067 | Broad | Yes | Yes | Yes | Yes | Yes | No |
| ADI-56068 | SARS1-2 specific | No | Yes | No | No | No | No |
| ADI-56069 | Broad | Yes | Yes | Yes | Yes | Yes | No |
| ADI-56070 | SARS1-2 specific | No | Yes | No | No | No | No |
| ADI-56071 | SARS1-2 specific | Yes | Yes | No | No | No | No |
| ADI-56072 | SARS1-2 specific | No | Yes | No | No | No | No |

FIG. 12H

| ADI ID | Broad cross-reactivity with 1 or more circulating CoVs | SARS-CoV S binder? | SARS-CoV-2 S binder? | HCoV-229E S binder? | HKU1 S binder? | NL63 S binder? | OK43 S binder? |
|---|---|---|---|---|---|---|---|
| ADI-56073 | SARS1-2 specific | Yes | Yes | No | No | No | No |
| ADI-56074 | SARS1-2 specific | Yes | Yes | No | No | No | No |
| ADI-56075 | Broad | Yes | Yes | No | Yes | No | No |
| ADI-56076 | Broad | Yes | Yes | Yes | Yes | Yes | No |
| ADI-56078 | SARS1-2 specific | No | Yes | No | No | No | No |
| ADI-56079 | Broad | Yes | Yes | Yes | Yes | Yes | No |
| ADI-56080 | Broad | Yes | Yes | Yes | Yes | Yes | No |
| ADI-56081 | SARS1-2 specific | Yes | Yes | No | No | No | No |
| ADI-56082 | SARS1-2 specific | Yes | Yes | No | No | No | No |
| ADI-56083 | SARS1-2 specific | Yes | Yes | No | No | No | No |
| ADI-56084 | SARS1-2 specific | Yes | Yes | No | No | No | No |

FIG. 12I

| ADI ID | Polyspecificity Score | Polyspecificity Category |
|---|---|---|
| ADI-55688 | 0.00 | A |
| ADI-55689 | 0.00 | A |
| ADI-55690 | 0.00 | A |
| ADI-55691 | 0.00 | A |
| ADI-55692 | 0.00 | A |
| ADI-55693 | | |
| ADI-55694 | 0.10 | B |
| ADI-55695 | 0.00 | A |
| ADI-55696 | 0.00 | A |
| ADI-55697 | 0.11 | B |
| ADI-55698 | 0.00 | A |
| ADI-55699 | 0.00 | A |
| ADI-55700 | 0.00 | A |
| ADI-55701 | 0.00 | A |
| ADI-55702 | | |
| ADI-55703 | 0.00 | A |
| ADI-55704 | 0.00 | A |
| ADI-55705 | 0.00 | A |
| ADI-55706 | 0.00 | A |
| ADI-55707 | 0.00 | A |
| ADI-55708 | 0.00 | A |
| ADI-55709 | | |
| ADI-55710 | 0.10 | B |
| ADI-55711 | 0.00 | A |
| ADI-55712 | 0.00 | A |
| ADI-55713 | | |
| ADI-55714 | 0.00 | A |
| ADI-55715 | 0.00 | A |
| ADI-55716 | 0.16 | B |
| ADI-55717 | | |
| ADI-55718 | 0.00 | A |
| ADI-55719 | 0.10 | A |
| ADI-55721 | 0.00 | A |
| ADI-55722 | 0.00 | A |
| ADI-55723 | 0.00 | A |
| ADI-55724 | 0.00 | A |
| ADI-55725 | 0.00 | A |
| ADI-55726 | 0.00 | A |
| ADI-55727 | 0.00 | A |
| ADI-55728 | 0.00 | A |
| ADI-55729 | 0.00 | A |
| ADI-55730 | 0.00 | A |
| ADI-55731 | 0.00 | A |
| ADI-55732 | 0.00 | A |
| ADI-55733 | 0.00 | A |
| ADI-55734 | 0.00 | A |
| ADI-55735 | 0.00 | A |
| ADI-55736 | 0.00 | A |
| ADI-55737 | 0.00 | A |
| ADI-55738 | | |
| ADI-55739 | | |
| ADI-55740 | 0.00 | A |
| ADI-55741 | 0.00 | A |
| ADI-55742 | 0.00 | A |
| ADI-55743 | 0.00 | A |
| ADI-55744 | | |
| ADI-55745 | 0.00 | A |
| ADI-55746 | 0.00 | A |
| ADI-55747 | 0.00 | A |
| ADI-55748 | 0.00 | A |
| ADI-55749 | 0.00 | A |
| ADI-55750 | 0.00 | A |
| ADI-55751 | 0.00 | A |
| ADI-55752 | 0.00 | A |
| ADI-55753 | 0.00 | A |
| ADI-55754 | 0.00 | A |
| ADI-55755 | 0.00 | A |
| ADI-55756 | 0.00 | A |
| ADI-55757 | | |
| ADI-55758 | | |
| ADI-55720 | | |
| ADI-55760 | | |
| ADI-55761 | | |
| ADI-55762 | | |
| ADI-55763 | | |

FIG. 13A

| ADI ID | Polyspecificity Score | Polyspecificity Category |
|---|---|---|
| ADI-55765 | | |
| ADI-55766 | | |
| ADI-55767 | | |
| ADI-55769 | | |
| ADI-55770 | | |
| ADI-55771 | | |
| ADI-55775 | | |
| ADI-55776 | | |
| ADI-55777 | | |
| ADI-55950 | 0.07 | A |
| ADI-55951 | 0.06 | A |
| ADI-55952 | 0.08 | A |
| ADI-55953 | 0.06 | A |
| ADI-55954 | 0.05 | A |
| ADI-55955 | 0.04 | A |
| ADI-55956 | 0.08 | A |
| ADI-55957 | 0.08 | A |
| ADI-55958 | 0.06 | A |
| ADI-55959 | 0.04 | A |
| ADI-55960 | 0.04 | A |
| ADI-55961 | 0.10 | B |
| ADI-55962 | 0.02 | A |
| ADI-55963 | 0.10 | B |
| ADI-55964 | 0.05 | A |
| ADI-55965 | 0.07 | A |

| ADI ID | Polyspecificity Score | Polyspecificity Category |
|---|---|---|
| ADI-55966 | 0.06 | A |
| ADI-55967 | 0.06 | A |
| ADI-55968 | 0.06 | A |
| ADI-55969 | 0.23 | B |
| ADI-55970 | 0.10 | B |
| ADI-55972 | 0.04 | A |
| ADI-55973 | 0.06 | A |
| ADI-55974 | 0.06 | A |
| ADI-55975 | 0.10 | B |
| ADI-55976 | 0.10 | B |
| ADI-55977 | 0.06 | A |
| ADI-55978 | 0.04 | A |
| ADI-55979 | 0.05 | A |
| ADI-55980 | 0.10 | B |
| ADI-55981 | 0.08 | A |
| ADI-55982 | 0.07 | A |
| ADI-55984 | 0.06 | A |
| ADI-55986 | 0.83 | D |
| ADI-55988 | 0.07 | A |
| ADI-55989 | 0.08 | A |
| ADI-55990 | 0.08 | A |
| ADI-55992 | 0.06 | A |
| ADI-55993 | 0.04 | A |
| ADI-55994 | 0.06 | A |
| ADI-55995 | 0.07 | A |

| ADI ID | Polyspecificity Score | Polyspecificity Category |
|---|---|---|
| ADI-55996 | 0.07 | A |
| ADI-55997 | 0.10 | B |
| ADI-55998 | 0.10 | B |
| ADI-55999 | 0.09 | A |
| ADI-56000 | 0.05 | A |
| ADI-56001 | 0.08 | A |
| ADI-56002 | 0.04 | A |
| ADI-56003 | 0.06 | A |
| ADI-56004 | 0.05 | A |
| ADI-56005 | 0.06 | A |
| ADI-56006 | 0.08 | A |
| ADI-56007 | 0.10 | B |
| ADI-56008 | 0.10 | A |
| ADI-56009 | 0.06 | A |
| ADI-56010 | 0.07 | A |
| ADI-56011 | 0.08 | B |
| ADI-56012 | 0.04 | A |
| ADI-56013 | 0.11 | B |
| ADI-56014 | 0.06 | A |
| ADI-56015 | 0.09 | A |
| ADI-56016 | 0.14 | B |
| ADI-56017 | 0.10 | B |
| ADI-56018 | 0.07 | A |
| ADI-56019 | 0.07 | A |
| ADI-56020 | 0.05 | A |

FIG. 13B

| ADI ID | Polyspecificity Score | Polyspecificity Category |
|---|---|---|
| ADI-56021 | 0.08 | A |
| ADI-56022 | 0.06 | A |
| ADI-56023 | 0.10 | B |
| ADI-56024 | 0.07 | A |
| ADI-56025 | 0.10 | B |
| ADI-56026 | 0.11 | B |
| ADI-56027 | 0.10 | B |
| ADI-56028 | 0.06 | A |
| ADI-56029 | 0.06 | A |
| ADI-56030 | 0.05 | A |
| ADI-56031 | 0.07 | A |
| ADI-56032 | 0.05 | A |
| ADI-56033 | 0.06 | A |
| ADI-56034 | 0.08 | B |
| ADI-56035 | 0.10 | A |
| ADI-56037 | 0.06 | B |
| ADI-56038 | 0.10 | A |
| ADI-56039 | 0.05 | A |
| ADI-56040 | 0.04 | A |
| ADI-56041 | 0.06 | A |
| ADI-56042 | 0.05 | A |
| ADI-56043 | 0.06 | A |
| ADI-56044 | 0.06 | A |
| ADI-56045 | 0.00 | A |
| ADI-56046 | 0.00 | A |

| ADI ID | Polyspecificity Score | Polyspecificity Category |
|---|---|---|
| ADI-56047 | 0.04 | A |
| ADI-56048 | 0.00 | A |
| ADI-56049 | 0.00 | A |
| ADI-56050 | 0.00 | A |
| ADI-56051 | 0.00 | A |
| ADI-56052 | 0.01 | A |
| ADI-56053 | 0.04 | A |
| ADI-56054 | 0.00 | A |
| ADI-56055 | 0.00 | A |
| ADI-56056 | 0.00 | A |
| ADI-56057 | 0.00 | A |
| ADI-56058 | 0.00 | A |
| ADI-56059 | 0.00 | A |
| ADI-56061 | 0.00 | A |
| ADI-56062 | 0.00 | A |
| ADI-56063 | 0.00 | A |
| ADI-56064 | 0.00 | A |
| ADI-56065 | 0.00 | A |
| ADI-56066 | 0.00 | A |
| ADI-56067 | 0.00 | A |
| ADI-56068 | 0.00 | A |
| ADI-56069 | 0.00 | A |
| ADI-56070 | 0.00 | A |
| ADI-56071 | 0.00 | A |
| ADI-56072 | 0.00 | A |

| ADI ID | Polyspecificity Score | Polyspecificity Category |
|---|---|---|
| ADI-56073 | 0.00 | A |
| ADI-56074 | 0.10 | B |
| ADI-56075 | 0.00 | A |
| ADI-56076 | 0.02 | A |
| ADI-56078 | 0.12 | B |
| ADI-56079 | 0.00 | A |
| ADI-56080 | 0.00 | A |
| ADI-56081 | 0.00 | A |
| ADI-56082 | 0.08 | A |
| ADI-56083 | 0.08 | A |
| ADI-56084 | 0.02 | A |

FIG. 13C

| ADI ID | Monovalent SARS-CoV-2 S1 KD [M] | Monovalent SARS-CoV-2 S1 kon | Monovalent SARS-CoV-2 S1 koff | Monovalent SARS-CoV-2 S1 Response | AVID SARS-CoV-2 S1 KD [M] | AVID SARS-CoV-2 S1 kon | AVID SARS-CoV-2 S1 koff | AVID SARS-CoV-2 S1 Response |
|---|---|---|---|---|---|---|---|---|
| ADI-55688 | 1.00E-06 | | | 0.30 | 1.61E-09 | 3.20E+05 | 5.14E-04 | 0.59 |
| ADI-55689 | 2.12E-08 | 1.78E+05 | 3.78E-03 | 0.43 | 6.03E-10 | 3.80E+05 | 2.29E-04 | 0.61 |
| ADI-55690 | 1.41E-07 | 9.36E+04 | 1.32E-02 | 0.36 | 8.45E-10 | 3.85E+05 | 3.26E-04 | 0.56 |
| ADI-55691 | N.B. | | | 0.05 | N.B. | | | 0.02 |
| ADI-55692 | 2.15E-08 | 1.04E+05 | 2.23E-03 | 0.23 | 2.17E-08 | 6.71E+05 | 1.46E-02 | 0.49 |
| ADI-55693 | | | | | | | | |
| ADI-55694 | 1.00E-06 | | | 0.16 | 3.92E-09 | 1.83E+05 | 7.20E-04 | 0.48 |
| ADI-55695 | N.B. | | | 0.02 | N.B. | | | -0.01 |
| ADI-55696 | N.B. | | | 0.04 | N.B. | | | -0.01 |
| ADI-55697 | N.B. | | | 0.08 | 3.52E-07 | 1.24E+05 | 4.35E-02 | 0.11 |
| ADI-55698 | N.B. | | | 0.02 | N.B. | | | 0.01 |
| ADI-55699 | 1.69E-09 | 1.18E+05 | 2.00E-04 | 0.50 | 3.85E-10 | 3.12E+05 | 1.20E-04 | 0.66 |
| ADI-55700 | N.B. | | | 0.02 | N.B. | | | 0.00 |
| ADI-55701 | N.B. | | | 0.03 | N.B. | | | 0.00 |
| ADI-55702 | | | | | | | | |
| ADI-55703 | N.B. | | | 0.02 | N.B. | | | 0.02 |
| ADI-55704 | N.B. | | | 0.01 | N.B. | | | 0.01 |
| ADI-55705 | N.B. | | | 0.03 | N.B. | | | 0.01 |
| ADI-55706 | N.B. | | | 0.03 | N.B. | | | -0.01 |
| ADI-55707 | N.B. | | | 0.10 | 3.92E-09 | 1.28E+05 | 5.02E-04 | 0.33 |
| ADI-55708 | 2.69E-07 | 4.59E+04 | 1.24E-02 | 0.12 | 3.45E-09 | 1.26E+05 | 4.33E-04 | 0.32 |
| ADI-55709 | | | | | | | | |
| ADI-55710 | N.B. | | | 0.06 | 3.48E-08 | 4.04E+05 | 1.41E-02 | 0.17 |
| ADI-55711 | 4.21E-09 | 8.79E+04 | 3.70E-04 | 0.24 | 5.22E-10 | 2.30E+05 | 1.20E-04 | 0.29 |
| ADI-55712 | N.B. | | | 0.02 | N.B. | | | 0.00 |

| ADI ID | Monovalent SARS-CoV-2 S1 KD [M] | Monovalent SARS-CoV-2 S1 kon | Monovalent SARS-CoV-2 S1 koff | Monovalent SARS-CoV-2 S1 Response | AVID SARS-CoV-2 S1 KD [M] | AVID SARS-CoV-2 S1 kon | AVID SARS-CoV-2 S1 koff | AVID SARS-CoV-2 S1 Response |
|---|---|---|---|---|---|---|---|---|
| ADI-55713 | | | | | | | | |
| ADI-55714 | N.B. | | | 0.02 | N.B. | | | 0.01 |
| ADI-55715 | N.B. | | | 0.03 | N.B. | | | 0.01 |
| ADI-55716 | N.B. | | | 0.05 | 5.82E-08 | 1.37E+05 | 8.00E-03 | 0.24 |
| ADI-55717 | | | | | | | | |
| ADI-55718 | N.B. | | | 0.06 | 4.30E-08 | 1.98E+05 | 8.51E-03 | 0.25 |
| ADI-55719 | N.B. | | | 0.08 | 5.11E-09 | 1.09E+05 | 5.57E-04 | 0.31 |
| ADI-55721 | N.B. | | | 0.03 | N.B. | | | -0.01 |
| ADI-55722 | N.B. | | | 0.02 | N.B. | | | 0.01 |
| ADI-55723 | N.B. | | | 0.01 | N.B. | | | 0.02 |
| ADI-55724 | N.B. | | | 0.03 | N.B. | | | 0.02 |
| ADI-55725 | N.B. | | | -0.01 | N.B. | | | 0.02 |
| ADI-55726 | N.B. | | | 0.04 | N.B. | | | 0.01 |
| ADI-55727 | 1.41E-08 | 9.20E+04 | 1.30E-03 | 0.27 | 9.79E-10 | 2.25E+05 | 2.20E-04 | 0.41 |
| ADI-55728 | N.B. | | | 0.03 | N.B. | | | 0.01 |
| ADI-55729 | N.B. | | | 0.03 | N.B. | | | 0.03 |
| ADI-55730 | N.B. | | | 0.05 | 6.30E-08 | 2.60E+05 | 1.64E-02 | 0.16 |
| ADI-55731 | N.B. | | | 0.03 | N.B. | | | 0.01 |
| ADI-55732 | N.B. | | | 0.02 | N.B. | | | 0.01 |
| ADI-55733 | N.B. | | | 0.05 | n.d. | | | |
| ADI-55734 | 1.04E-08 | 1.06E+05 | 1.10E-03 | 0.20 | 2.18E-09 | 1.73E+05 | 3.78E-04 | 0.27 |
| ADI-55735 | N.B. | | | 0.04 | N.B. | | | 0.01 |
| ADI-55736 | N.B. | | | 0.03 | N.B. | | | -0.01 |
| ADI-55737 | 1.00E-06 | | | | | | | |
| ADI-55738 | 1.00E-06 | | | 0.12 | 1.77E-08 | 3.54E+05 | 6.27E-03 | 0.41 |

FIG. 15C

| ADI ID | Monovalent SARS-CoV-2 S1 KD [M] | Monovalent SARS-CoV-2 S1 kon | Monovalent SARS-CoV-2 S1 koff | Monovalent SARS-CoV-2 S1 Response | AVID SARS-CoV-2 S1 KD [M] | AVID SARS-CoV-2 S1 kon | AVID SARS-CoV-2 S1 koff | AVID SARS-CoV-2 S1 Response |
|---|---|---|---|---|---|---|---|---|
| ADI-55739 | N.B. | | | 0.01 | N.B. | | | -0.01 |
| ADI-55740 | N.B. | | | 0.03 | N.B. | | | -0.01 |
| ADI-55741 | N.B. | | | 0.03 | N.B. | | | 0.01 |
| ADI-55742 | N.B. | | | 0.02 | N.B. | | | 0.00 |
| ADI-55743 | N.B. | | | 0.03 | N.B. | | | 0.01 |
| ADI-55744 | | | | | | | | |
| ADI-55745 | N.B. | | | 0.02 | N.B. | | | 0.00 |
| ADI-55746 | N.B. | | | 0.01 | N.B. | | | 0.00 |
| ADI-55747 | N.B. | | | 0.05 | N.B. | | | 0.00 |
| ADI-55748 | N.B. | | | 0.02 | N.B. | | | 0.03 |
| ADI-55749 | 1.79E-09 | 1.12E+05 | 2.00E-04 | 0.37 | 5.16E-10 | 2.33E+05 | 1.20E-04 | 0.58 |
| ADI-55750 | N.B. | | | 0.04 | N.B. | | | 0.02 |
| ADI-55751 | N.B. | | | 0.03 | N.B. | | | 0.04 |
| ADI-55752 | N.B. | | | 0.00 | N.B. | | | -0.01 |
| ADI-55753 | N.B. | | | 0.02 | n.d. | | | |
| ADI-55754 | 3.42E-09 | 1.02E+05 | 3.50E-04 | 0.41 | 5.64E-10 | 2.13E+05 | 1.20E-04 | 0.55 |
| ADI-55755 | N.B. | | | 0.01 | N.B. | | | 0.00 |
| ADI-55756 | N.B. | | | 0.03 | N.B. | | | 0.01 |
| ADI-55757 | N.B. | | | 0.10 | n.d. | | | |
| ADI-55758 | N.B. | | | 0.02 | n.d. | | | |
| ADI-55720 | | | | | | | | |
| ADI-55760 | N.B. | | | 0.01 | n.d. | | | |
| ADI-55761 | N.B. | | | 0.01 | n.d. | | | |
| ADI-55762 | N.B. | | | 0.03 | n.d. | | | |
| ADI-55763 | N.B. | | | 0.04 | | | | |

FIG. 15D

| ADI ID | Monovalent SARS-CoV-2 S1 KD [M] | Monovalent SARS-CoV-2 S1 kon | Monovalent SARS-CoV-2 S1 koff | Monovalent SARS-CoV-2 S1 Response | AVID SARS-CoV-2 S1 KD [M] | AVID SARS-CoV-2 S1 kon | AVID SARS-CoV-2 S1 koff | AVID SARS-CoV-2 S1 Response |
|---|---|---|---|---|---|---|---|---|
| ADI-55765 | N.B. | | | 0.02 | | | | |
| ADI-55766 | N.B. | | | 0.01 | | | | |
| ADI-55767 | N.B. | | | 0.04 | | | | |
| ADI-55769 | N.B. | | | 0.02 | | | | |
| ADI-55770 | N.B. | | | 0.03 | | | | |
| ADI-55771 | N.B. | | | 0.04 | | | | |
| ADI-55775 | N.B. | | | 0.03 | | | | |
| ADI-55776 | N.B. | | | 0.04 | | | | |
| ADI-55777 | N.B. | | | 0.02 | n.d. | | | 0.00 |
| ADI-55950 | N.B. | | | 0.00 | n.d. | | | 0.46 |
| ADI-55951 | 1.00E-06 | | | 0.17 | 5.75E-09 | 1.63E+05 | 9.39E-04 | 0.01 |
| ADI-55952 | N.B. | | | 0.00 | N.B. | | | 0.00 |
| ADI-55953 | N.B. | | | 0.02 | N.B. | | | 0.00 |
| ADI-55954 | N.B. | | | 0.01 | N.B. | | | 0.35 |
| ADI-55955 | 8.59E-08 | 4.96E+04 | 4.26E-03 | 0.12 | 2.14E-09 | 1.59E+05 | 3.40E-04 | -0.01 |
| ADI-55956 | N.B. | | | 0.00 | N.B. | | | 0.00 |
| ADI-55957 | N.B. | | | 0.02 | N.B. | | | 0.40 |
| ADI-55958 | 2.61E-07 | 3.03E+04 | 7.93E-03 | 0.18 | 7.98E-09 | 1.19E+05 | 9.49E-04 | 0.00 |
| ADI-55959 | N.B. | | | 0.01 | N.B. | | | 0.34 |
| ADI-55960 | N.B. | | | 0.08 | 3.69E-09 | 1.49E+05 | 5.48E-04 | 0.01 |
| ADI-55961 | N.B. | | | 0.00 | N.B. | | | 0.00 |
| ADI-55962 | N.B. | | | 0.01 | N.B. | | | 0.01 |
| ADI-55963 | N.B. | | | 0.01 | N.B. | | | 0.04 |
| ADI-55964 | N.B. | | | 0.02 | N.B. | | | -0.02 |
| ADI-55965 | N.B. | | | 0.01 | | | | |

| ADI ID | Monovalent SARS-CoV-2 S1 KD [M] | Monovalent SARS-CoV-2 S1 kon | Monovalent SARS-CoV-2 S1 koff | Monovalent SARS-CoV-2 S1 Response | AVID SARS-CoV-2 S1 KD [M] | AVID SARS-CoV-2 S1 kon | AVID SARS-CoV-2 S1 koff | AVID SARS-CoV-2 S1 Response |
|---|---|---|---|---|---|---|---|---|
| ADI-55966 | N.B. | | | 0.01 | N.B. | | | 0.01 |
| ADI-55967 | N.B. | | | 0.01 | N.B. | | | 0.00 |
| ADI-55968 | N.B. | | | 0.01 | N.B. | | | 0.00 |
| ADI-55969 | N.B. | | | 0.06 | 2.31E-09 | 5.43E+05 | 1.26E-03 | 0.26 |
| ADI-55970 | N.B. | | | 0.00 | N.B. | | | 0.01 |
| ADI-55972 | N.B. | | | 0.02 | N.B. | | | 0.00 |
| ADI-55973 | N.B. | | | 0.02 | N.B. | | | 0.00 |
| ADI-55974 | N.B. | | | 0.00 | N.B. | | | 0.01 |
| ADI-55975 | N.B. | | | 0.00 | N.B. | | | 0.04 |
| ADI-55976 | N.B. | | | 0.01 | N.B. | | | -0.01 |
| ADI-55977 | N.B. | | | 0.04 | 9.05E-08 | 2.18E+05 | 1.98E-02 | 0.20 |
| ADI-55978 | 1.09E-07 | 6.20E+04 | 6.75E-03 | 0.10 | 3.44E-09 | 1.97E+05 | 6.76E-04 | 0.36 |
| ADI-55979 | N.B. | | | 0.00 | N.B. | | | -0.01 |
| ADI-55980 | N.B. | | | 0.02 | N.B. | | | 0.00 |
| ADI-55981 | N.B. | | | 0.02 | N.B. | | | -0.01 |
| ADI-55982 | N.B. | | | 0.03 | N.B. | | | 0.01 |
| ADI-55984 | N.B. | | | 0.02 | N.B. | | | 0.01 |
| ADI-55986 | N.B. | | | 0.02 | N.B. | | | 0.02 |
| ADI-55988 | N.B. | | | 0.04 | 5.81E-08 | 2.62E+05 | 1.52E-02 | 0.17 |
| ADI-55989 | N.B. | | | 0.02 | N.B. | | | 0.00 |
| ADI-55990 | N.B. | | | 0.00 | N.B. | | | -0.02 |
| ADI-55992 | N.B. | | | 0.02 | N.B. | | | 0.01 |
| ADI-55993 | N.B. | | | 0.09 | 1.72E-09 | 6.97E+04 | 1.20E-04 | 0.23 |
| ADI-55994 | N.B. | | | 0.01 | N.B. | | | -0.01 |
| ADI-55995 | N.B. | | | 0.00 | N.B. | | | 0.00 |

FIG. 15E

| ADI ID | Monovalent SARS-CoV-2 S1 KD [M] | Monovalent SARS-CoV-2 S1 kon | Monovalent SARS-CoV-2 S1 koff | Monovalent SARS-CoV-2 S1 Response | AVID SARS-CoV-2 S1 KD [M] | AVID SARS-CoV-2 S1 kon | AVID SARS-CoV-2 S1 koff | AVID SARS-CoV-2 S1 Response |
|---|---|---|---|---|---|---|---|---|
| ADI-55996 | N.B. | | | 0.02 | N.B. | | | 0.01 |
| ADI-55997 | N.B. | | | 0.00 | N.B. | | | 0.04 |
| ADI-55998 | 3.61E-07 | 3.36E+04 | 1.21E-02 | 0.13 | 6.32E-09 | 8.01E+04 | 5.06E-04 | 0.27 |
| ADI-55999 | N.B. | | | 0.02 | N.B. | | | 0.01 |
| ADI-56000 | 8.05E-08 | 2.15E+04 | 1.73E-03 | 0.10 | 1.66E-09 | 7.24E+04 | 1.20E-04 | 0.30 |
| ADI-56001 | N.B. | | | 0.00 | N.B. | | | 0.00 |
| ADI-56002 | N.B. | | | 0.02 | N.B. | | | 0.00 |
| ADI-56003 | N.B. | | | 0.07 | 1.67E-09 | 7.19E+04 | 1.20E-04 | 0.16 |
| ADI-56004 | N.B. | | | 0.08 | 4.49E-09 | 1.72E+05 | 7.71E-04 | 0.21 |
| ADI-56005 | N.B. | | | 0.01 | N.B. | | | 0.02 |
| ADI-56006 | N.B. | | | 0.01 | N.B. | | | -0.01 |
| ADI-56007 | N.B. | | | 0.06 | 4.86E-08 | 4.13E+05 | 2.01E-02 | 0.28 |
| ADI-56008 | N.B. | | | 0.00 | N.B. | | | 0.01 |
| ADI-56009 | N.B. | | | 0.03 | N.B. | | | 0.01 |
| ADI-56010 | 1.03E-08 | 1.06E+05 | 1.09E-03 | 0.47 | 4.58E-10 | 2.62E+05 | 1.20E-04 | 0.62 |
| ADI-56011 | 7.22E-08 | 4.41E+04 | 3.18E-03 | 0.17 | 1.35E-09 | 2.84E+05 | 3.86E-04 | 0.29 |
| ADI-56012 | N.B. | | | 0.01 | N.B. | | | 0.00 |
| ADI-56013 | N.B. | | | 0.02 | N.B. | | | 0.00 |
| ADI-56014 | N.B. | | | 0.00 | N.B. | | | 0.01 |
| ADI-56015 | N.B. | | | 0.01 | N.B. | | | 0.01 |
| ADI-56016 | N.B. | | | 0.03 | N.B. | | | 0.02 |
| ADI-56017 | N.B. | | | 0.01 | N.B. | | | 0.08 |
| ADI-56018 | N.B. | | | 0.01 | N.B. | | | 0.01 |
| ADI-56019 | N.B. | | | 0.01 | N.B. | | | 0.00 |
| ADI-56020 | 2.85E-09 | 7.01E+04 | 2.00E-04 | 0.19 | 1.25E-09 | 9.58E+04 | 1.20E-04 | 0.42 |

FIG. 15F

| ADI ID | Monovalent SARS-CoV-2 S1 KD [M] | Monovalent SARS-CoV-2 S1 kon | Monovalent SARS-CoV-2 S1 koff | Monovalent SARS-CoV-2 S1 Response | AVID SARS-CoV-2 S1 KD [M] | AVID SARS-CoV-2 S1 kon | AVID SARS-CoV-2 S1 koff | AVID SARS-CoV-2 S1 Response |
|---|---|---|---|---|---|---|---|---|
| ADI-56021 | N.B. | | | 0.01 | N.B. | | | 0.02 |
| ADI-56022 | N.B. | | | 0.02 | N.B. | | | -0.01 |
| ADI-56023 | N.B. | | | 0.02 | N.B. | | | 0.00 |
| ADI-56024 | N.B. | | | 0.04 | 9.60E-09 | 1.69E+05 | 1.62E-03 | 0.17 |
| ADI-56025 | N.B. | | | 0.01 | N.B. | | | -0.01 |
| ADI-56026 | N.B. | | | 0.03 | 6.10E-08 | 1.46E+05 | 8.89E-03 | 0.12 |
| ADI-56027 | N.B. | | | 0.00 | N.B. | | | -0.01 |
| ADI-56028 | N.B. | | | 0.03 | N.B. | | | 0.01 |
| ADI-56029 | N.B. | | | 0.02 | N.B. | | | -0.01 |
| ADI-56030 | N.B. | | | 0.00 | N.B. | | | 0.01 |
| ADI-56031 | N.B. | | | 0.02 | N.B. | | | 0.00 |
| ADI-56032 | N.B. | | | 0.02 | N.B. | | | 0.02 |
| ADI-56033 | N.B. | | | 0.01 | N.B. | | | 0.00 |
| ADI-56034 | N.B. | | | 0.02 | N.B. | | | -0.01 |
| ADI-56035 | 1.00E-06 | | | 0.16 | 5.88E-09 | 2.27E+05 | 1.34E-03 | 0.56 |
| ADI-56037 | N.B. | 7.90E+04 | 4.85E-03 | 0.01 | N.B. | | | 0.00 |
| ADI-56038 | N.B. | | | 0.01 | N.B. | | | -0.01 |
| ADI-56039 | N.B. | | | 0.01 | N.B. | | | 0.01 |
| ADI-56040 | 6.14E-08 | | | 0.22 | 8.16E-10 | 1.47E+05 | 1.20E-04 | 0.50 |
| ADI-56041 | N.B. | | | 0.02 | N.B. | | | 0.00 |
| ADI-56042 | N.B. | | | 0.03 | 5.79E-09 | 6.58E+04 | 3.81E-04 | 0.14 |
| ADI-56043 | N.B. | | | 0.01 | N.B. | | | -0.02 |
| ADI-56044 | N.B. | | | 0.01 | N.B. | | | -0.01 |
| ADI-56045 | N.B. | | | 0.01 | N.B. | | | 0.00 |
| ADI-56046 | 3.31E-09 | 1.32E+05 | 4.36E-04 | 0.52 | 3.28E-10 | 3.66E+05 | 1.20E-04 | 0.63 |

FIG. 15G

| ADI ID | Monovalent SARS-CoV-2 S1 KD [M] | Monovalent SARS-CoV-2 S1 kon | Monovalent SARS-CoV-2 S1 koff | Monovalent SARS-CoV-2 S1 Response | AVID SARS-CoV-2 S1 KD [M] | AVID SARS-CoV-2 S1 kon | AVID SARS CoV-2 S1 koff | AVID SARS-CoV-2 S1 Response |
|---|---|---|---|---|---|---|---|---|
| ADI-56047 | N.B. | | | 0.01 | N.B. | | | 0.01 |
| ADI-56048 | N.B. | | | 0.01 | N.B. | | | 0.00 |
| ADI-56049 | N.B. | | | -0.01 | N.B. | | | 0.01 |
| ADI-56050 | N.B. | | | 0.02 | N.B. | | | 0.01 |
| ADI-56051 | N.B. | | | 0.02 | 5.49E-08 | 2.06E+04 | 1.13E-03 | 0.16 |
| ADI-56052 | N.B. | | | 0.01 | N.B. | | | 0.00 |
| ADI-56053 | N.B. | | | 0.01 | 1.00E-06 | | | 0.11 |
| ADI-56054 | N.B. | | | -0.01 | N.B. | | | -0.01 |
| ADI-56055 | N.B. | | | 0.00 | N.B. | | | -0.01 |
| ADI-56056 | N.B. | | | 0.02 | N.B. | | | 0.02 |
| ADI-56057 | N.B. | | | 0.00 | N.B. | | | 0.02 |
| ADI-56058 | N.B. | | | 0.08 | 5.53E-09 | 1.09E+05 | 6.03E-04 | 0.42 |
| ADI-56059 | N.B. | | | 0.01 | N.B. | | | 0.01 |
| ADI-56061 | N.B. | | | 0.01 | N.B. | | | -0.01 |
| ADI-56062 | N.B. | | | 0.01 | N.B. | | | 0.01 |
| ADI-56063 | N.B. | | | 0.00 | N.B. | | | 0.01 |
| ADI-56064 | N.B. | | | 0.00 | N.B. | | | 0.01 |
| ADI-56065 | N.B. | | | 0.04 | 1.25E-08 | 1.02E+05 | 1.27E-03 | 0.28 |
| ADI-56066 | N.B. | | | 0.02 | N.B. | | | 0.08 |
| ADI-56067 | N.B. | | | -0.01 | N.B. | | | 0.00 |
| ADI-56068 | N.B. | | | 0.02 | N.B. | | | 0.04 |
| ADI-56069 | N.B. | | | 0.01 | N.B. | | | -0.01 |
| ADI-56070 | N.B. | | | 0.01 | 1.95E-08 | 1.08E+05 | 2.10E-03 | 0.17 |
| ADI-56071 | 3.75E-07 | 3.55E+04 | 1.33E-02 | 0.21 | 1.54E-09 | 7.78E+04 | 1.20E-04 | 0.45 |
| ADI-56072 | N.B. | | | 0.01 | N.B. | | | 0.01 |

FIG. 15H

| ADI ID | Monovalent SARS-CoV-2 S1 KD [M] | Monovalent SARS-CoV-2 S1 kon | Monovalent SARS-CoV-2 S1 koff | Monovalent SARS-CoV-2 S1 Response | AVID SARS-CoV-2 S1 KD [M] | AVID SARS-CoV-2 S1 kon | AVID SARS-CoV-2 S1 koff | AVID SARS-CoV-2 S1 Response |
|---|---|---|---|---|---|---|---|---|
| ADI-56073 | N.B. | | | 0.01 | N.B. | | | 0.04 |
| ADI-56074 | N.B. | | | 0.04 | 2.23E-09 | 1.09E+05 | 2.44E-04 | 0.14 |
| ADI-56075 | N.B. | | | 0.01 | N.B. | | | 0.00 |
| ADI-56076 | N.B. | | | 0.02 | N.B. | | | 0.00 |
| ADI-56078 | N.B. | | | 0.02 | N.B. | | | 0.03 |
| ADI-56079 | N.B. | | | 0.02 | N.B. | | | 0.01 |
| ADI-56080 | N.B. | | | 0.03 | N.B. | | | 0.01 |
| ADI-56081 | 3.48E-09 | 7.92E+04 | 2.76E-04 | 0.30 | 4.38E-10 | 2.74E+05 | 1.20E-04 | 0.37 |
| ADI-56082 | N.B. | | | 0.00 | N.B. | | | -0.01 |
| ADI-56083 | N.B. | | | 0.02 | N.B. | | | 0.01 |
| ADI-56084 | N.B. | | | 0.02 | N.B. | | | -0.01 |

FIG. 15I

| ADI ID | SARS-CoV-2 S2 KD [M] | SARS-CoV-2 S2 kon | SARS-CoV-2 S2 koff | SARS-CoV-2 S2 Response |
|---|---|---|---|---|
| ADI-55688 | N.B. | | | 0.04 |
| ADI-55689 | N.B. | | | 0.04 |
| ADI-55690 | N.B. | | | 0.03 |
| ADI-55691 | N.B. | | | 0.02 |
| ADI-55692 | N.B. | | | 0.03 |
| ADI-55693 | | | | |
| ADI-55694 | N.B. | | | 0.02 |
| ADI-55695 | N.B. | | | 0.02 |
| ADI-55696 | N.B. | | | 0.03 |
| ADI-55697 | N.B. | | | 0.04 |
| ADI-55698 | N.B. | | | 0.04 |
| ADI-55699 | N.B. | | | 0.03 |
| ADI-55700 | N.B. | | | 0.04 |
| ADI-55701 | N.B. | | | 0.02 |
| ADI-55702 | | | | |
| ADI-55703 | 2.43E-09 | 1.97E+05 | 4.79E-04 | 0.28 |
| ADI-55704 | N.B. | | | 0.02 |
| ADI-55705 | N.B. | | | 0.03 |
| ADI-55706 | N.B. | | | 0.03 |
| ADI-55707 | N.B. | | | 0.03 |
| ADI-55708 | N.B. | | | 0.04 |
| ADI-55809 | | | | |
| ADI-55710 | N.B. | | | 0.02 |
| ADI-55711 | N.B. | | | 0.02 |
| ADI-55712 | N.B. | | | 0.04 |

| ADI ID | SARS-CoV-2 S2 KD [M] | SARS-CoV-2 S2 kon | SARS-CoV-2 S2 koff | SARS-CoV-2 S2 Response |
|---|---|---|---|---|
| ADI-55713 | | | | |
| ADI-55714 | N.B. | | | 0.03 |
| ADI-55715 | N.B. | | | 0.04 |
| ADI-55716 | N.B. | | | 0.02 |
| ADI-55717 | | | | |
| ADI-55718 | N.B. | | | 0.03 |
| ADI-55719 | N.B. | | | 0.03 |
| ADI-55721 | N.B. | | | 0.04 |
| ADI-55722 | N.B. | | | 0.03 |
| ADI-55723 | N.B. | | | 0.04 |
| ADI-55724 | 6.71E-10 | 1.79E+05 | 1.20E-04 | 0.53 |
| ADI-55725 | N.B. | | | 0.03 |
| ADI-55726 | N.B. | | | 0.03 |
| ADI-55727 | N.B. | | | 0.03 |
| ADI-55728 | N.B. | | | 0.04 |
| ADI-55729 | N.B. | | | 0.03 |
| ADI-55730 | N.B. | | | 0.06 |
| ADI-55731 | N.B. | | | 0.03 |
| ADI-55732 | 5.92E-10 | 2.13E+05 | 1.26E-04 | 0.52 |
| ADI-55733 | n.d. | | | |
| ADI-55734 | N.B. | | | 0.03 |
| ADI-55735 | N.B. | | | 0.04 |
| ADI-55736 | N.B. | | | 0.03 |
| ADI-55737 | N.B. | | | 0.04 |
| ADI-55738 | | | | |

FIG. 16A

| ADI ID | SARS-CoV-2 S2 KD [M] | SARS-CoV-2 S2 kon | SARS-CoV-2 S2 koff | SARS-CoV-2 S2 Response |
|---|---|---|---|---|
| ADI-55739 | N.B. | | | 0.02 |
| ADI-55740 | N.B. | | | 0.03 |
| ADI-55741 | N.B. | | | 0.02 |
| ADI-55742 | N.B. | | | 0.04 |
| ADI-55743 | N.B. | | | 0.03 |
| ADI-55744 | | | | |
| ADI-55745 | N.B. | | | 0.02 |
| ADI-55746 | 4.22E-09 | 9.43E+04 | 3.98E-04 | 0.21 |
| ADI-55747 | N.B. | | | 0.03 |
| ADI-55748 | N.B. | | | 0.05 |
| ADI-55749 | N.B. | | | 0.03 |
| ADI-55750 | N.B. | | | 0.03 |
| ADI-55751 | N.B. | | | 0.04 |
| ADI-55752 | N.B. | | | 0.03 |
| ADI-55753 | n.d. | | | 0.05 |
| ADI-55754 | N.B. | | | 0.03 |
| ADI-55755 | N.B. | | | 0.03 |
| ADI-55756 | N.B. | | | |
| ADI-55757 | n.d. | | | |
| ADI-55758 | n.d. | | | |
| ADI-55720 | | | | |
| ADI-55760 | n.d. | | | |
| ADI-55761 | n.d. | | | |
| ADI-55762 | n.d. | | | |
| ADI-55763 | n.d. | | | |

| ADI ID | SARS-CoV-2 S2 KD [M] | SARS-CoV-2 S2 kon | SARS-CoV-2 S2 koff | SARS-CoV-2 S2 Response |
|---|---|---|---|---|
| ADI-55765 | n.d. | | | |
| ADI-55766 | n.d. | | | |
| ADI-55767 | n.d. | | | |
| ADI-55769 | n.d. | | | |
| ADI-55770 | n.d. | | | |
| ADI-55771 | n.d. | | | |
| ADI-55775 | n.d. | | | |
| ADI-55776 | n.d. | | | |
| ADI-55777 | n.d. | | | |
| ADI-55950 | N.B. | | | 0.02 |
| ADI-55951 | N.B. | | | 0.04 |
| ADI-55952 | N.B. | | | 0.02 |
| ADI-55953 | N.B. | | | 0.03 |
| ADI-55954 | N.B. | | | 0.02 |
| ADI-55955 | N.B. | | | 0.03 |
| ADI-55956 | N.B. | | | 0.06 |
| ADI-55957 | N.B. | | | 0.01 |
| ADI-55958 | N.B. | | | 0.03 |
| ADI-55959 | N.B. | | | 0.03 |
| ADI-55960 | N.B. | | | 0.04 |
| ADI-55961 | N.B. | | | 0.02 |
| ADI-55962 | N.B. | | | 0.03 |
| ADI-55963 | N.B. | | | 0.03 |
| ADI-55964 | N.B. | | | 0.02 |
| ADI-55965 | N.B. | | | 0.04 |

FIG. 16B

| ADI ID | SARS-CoV-2 S2 KD [M] | SARS-CoV-2 S2 kon | SARS-CoV-2 S2 koff | SARS-CoV-2 S2 Response |
|---|---|---|---|---|
| ADI-55966 | N.B. | | | 0.03 |
| ADI-55967 | N.B. | | | 0.03 |
| ADI-55968 | N.B. | | | 0.04 |
| ADI-55969 | N.B. | | | 0.04 |
| ADI-55970 | N.B. | | | 0.03 |
| ADI-55972 | N.B. | | | 0.04 |
| ADI-55973 | N.B. | | | 0.04 |
| ADI-55974 | N.B. | | | 0.03 |
| ADI-55975 | N.B. | | | 0.04 |
| ADI-55976 | N.B. | | | 0.03 |
| ADI-55977 | N.B. | | | 0.04 |
| ADI-55978 | N.B. | | | 0.04 |
| ADI-55979 | N.B. | | | 0.04 |
| ADI-55980 | N.B. | | | 0.04 |
| ADI-55981 | N.B. | | | 0.04 |
| ADI-55982 | N.B. | | | 0.04 |
| ADI-55984 | N.B. | | | 0.04 |
| ADI-55986 | N.B. | | | 0.04 |
| ADI-55988 | N.B. | | | 0.04 |
| ADI-55989 | 1.40E-08 | 1.39E+05 | 1.95E-03 | 0.32 |
| ADI-55990 | N.B. | | | 0.03 |
| ADI-55992 | 9.25E-10 | 1.48E+05 | 1.37E-04 | 0.41 |
| ADI-55993 | N.B. | | | 0.04 |
| ADI-55994 | 1.00E-06 | | | 0.10 |
| ADI-55995 | N.B. | | | 0.05 |

| ADI ID | SARS-CoV-2 S2 KD [M] | SARS-CoV-2 S2 kon | SARS-CoV-2 S2 koff | SARS-CoV-2 S2 Response |
|---|---|---|---|---|
| ADI-55996 | N.B. | | | 0.03 |
| ADI-55997 | N.B. | | | 0.04 |
| ADI-55998 | N.B. | | | 0.05 |
| ADI-55999 | N.B. | | | 0.03 |
| ADI-56000 | N.B. | | | 0.04 |
| ADI-56001 | 1.27E-09 | 1.56E+05 | 1.99E-04 | 0.26 |
| ADI-56002 | N.B. | | | 0.03 |
| ADI-56003 | N.B. | | | 0.04 |
| ADI-56004 | N.B. | | | 0.04 |
| ADI-56005 | 1.19E-07 | 1.26E+05 | 1.50E-02 | 0.20 |
| ADI-56006 | 1.71E-09 | 3.05E+05 | 5.22E-04 | 0.28 |
| ADI-56007 | N.B. | | | 0.02 |
| ADI-56008 | N.B. | | | 0.04 |
| ADI-56009 | N.B. | | | 0.05 |
| ADI-56010 | N.B. | | | 0.05 |
| ADI-56011 | N.B. | | | 0.05 |
| ADI-56012 | N.B. | | | 0.03 |
| ADI-56013 | N.B. | | | 0.04 |
| ADI-56014 | N.B. | | | 0.04 |
| ADI-56015 | N.B. | | | 0.04 |
| ADI-56016 | 3.15E-08 | 1.49E+05 | 4.70E-03 | 0.36 |
| ADI-56017 | N.B. | | | 0.03 |
| ADI-56018 | N.B. | | | 0.03 |
| ADI-56019 | N.B. | | | 0.03 |
| ADI-56020 | N.B. | | | 0.04 |

FIG. 16C

| ADI ID | SARS-CoV-2 S2 KD [M] | SARS-CoV-2 S2 kon | SARS-CoV-2 S2 koff | SARS-CoV-2 S2 Response |
|---|---|---|---|---|
| ADI-56021 | N.B. | | | 0.04 |
| ADI-56022 | N.B. | | | 0.03 |
| ADI-56023 | N.B. | | | 0.04 |
| ADI-56024 | N.B. | | | 0.05 |
| ADI-56025 | N.B. | | | 0.05 |
| ADI-56026 | N.B. | | | 0.04 |
| ADI-56027 | N.B. | | | 0.04 |
| ADI-56028 | N.B. | | | 0.03 |
| ADI-56029 | N.B. | | | 0.03 |
| ADI-56030 | N.B. | | | 0.03 |
| ADI-56031 | N.B. | | | 0.04 |
| ADI-56032 | N.B. | | | 0.07 |
| ADI-56033 | 1.00E-06 | | | 0.26 |
| ADI-56034 | 4.87E-09 | 1.01E+05 | 4.93E-04 | 0.03 |
| ADI-56035 | N.B. | | | 0.03 |
| ADI-56037 | N.B. | | | 0.03 |
| ADI-56038 | N.B. | | | 0.04 |
| ADI-56039 | N.B. | | | 0.03 |
| ADI-56040 | N.B. | | | 0.04 |
| ADI-56041 | N.B. | | | 0.04 |
| ADI-56042 | N.B. | | | 0.51 |
| ADI-56043 | 6.95E-10 | 1.91E+05 | 1.33E-04 | 0.03 |
| ADI-56044 | N.B. | | | 0.00 |
| ADI-56045 | N.B. | | | 0.01 |
| ADI-56046 | N.B. | | | |

| ADI ID | SARS-CoV-2 S2 KD [M] | SARS-CoV-2 S2 kon | SARS-CoV-2 S2 koff | SARS-CoV-2 S2 Response |
|---|---|---|---|---|
| ADI-56047 | N.B. | | | 0.01 |
| ADI-56048 | N.B. | | | 0.02 |
| ADI-56049 | N.B. | | | 0.02 |
| ADI-56050 | N.B. | | | 0.01 |
| ADI-56051 | N.B. | | | 0.01 |
| ADI-56052 | N.B. | | | 0.02 |
| ADI-56053 | N.B. | | | 0.01 |
| ADI-56054 | N.B. | | | 0.01 |
| ADI-56055 | N.B. | | | 0.01 |
| ADI-56056 | N.B. | | | 0.02 |
| ADI-56057 | N.B. | | | 0.01 |
| ADI-56058 | N.B. | | | 0.02 |
| ADI-56059 | 2.55E-09 | 1.30E+05 | 3.30E-04 | 0.35 |
| ADI-56061 | N.B. | | | -0.01 |
| ADI-56062 | N.B. | | | 0.00 |
| ADI-56063 | N.B. | | | 0.00 |
| ADI-56064 | N.B. | | | 0.00 |
| ADI-56065 | N.B. | | | 0.00 |
| ADI-56066 | N.B. | | | 0.00 |
| ADI-56067 | N.B. | | | 0.00 |
| ADI-56068 | N.B. | | | 0.00 |
| ADI-56069 | N.B. | | | 0.01 |
| ADI-56070 | N.B. | | | -0.01 |
| ADI-56071 | N.B. | | | 0.01 |
| ADI-56072 | N.B. | | | 0.02 |

FIG. 16D

| AD ID | SARS-CoV-2 S2 KD [M] | SARS-CoV-2 S2 kon | SARS-CoV-2 S2 koff | SARS-CoV-2 S2 Response |
|---|---|---|---|---|
| AD-56073 | 2.60E-09 | 1.41E+05 | 3.65E-04 | 0.25 |
| AD-56074 | N.B. | | | 0.01 |
| AD-56075 | N.B. | | | 0.02 |
| AD-56076 | N.B. | | | 0.02 |
| AD-56078 | N.B. | | | 0.02 |
| AD-56079 | N.B. | | | 0.02 |
| AD-56080 | N.B. | | | 0.01 |
| AD-56081 | N.B. | | | 0.01 |
| AD-56082 | N.B. | | | 0.01 |
| AD-56083 | N.B. | | | 0.04 |
| AD-56084 | N.B. | | | 0.04 |

FIG. 16E

| ADI ID | Monovalent SARS-CoV-2 RBD KD [M] | Monovalent SARS-CoV-2 RBD kon | Monovalent SARS-CoV-2 RBD koff | Monovalent SARS-CoV-2 RBD Response | Avid SARS-CoV-2 RBD KD [M] | Avid SARS-CoV-2 RBD kon | Avid SARS-CoV-2 RBD koff | Avid SARS-CoV-2 RBD Response |
|---|---|---|---|---|---|---|---|---|
| ADI-55688 | 2.31E-07 | 8.03E+04 | 1.85E-02 | 0.40 | 1.40E-09 | 2.64E+05 | 3.68E-04 | 0.54 |
| ADI-55689 | 9.23E-09 | 1.82E+05 | 1.68E-03 | 0.58 | 6.19E-10 | 3.23E+05 | 2.00E-04 | 0.62 |
| ADI-55690 | 9.13E-09 | 2.44E+05 | 2.23E-03 | 0.55 | 6.80E-10 | 3.74E+05 | 2.54E-04 | 0.61 |
| ADI-55691 | N.B. | | | 0.07 | N.B. | | | 0.08 |
| ADI-55692 | 1.00E-06 | | | 0.26 | 3.32E-09 | 4.84E+05 | 1.61E-03 | 0.60 |
| ADI-55693 | | | | | | | | |
| ADI-55694 | 1.57E-07 | 8.42E+04 | 1.32E-02 | 0.23 | 2.83E-09 | 1.98E+05 | 5.60E-04 | 0.44 |
| ADI-55695 | N.B. | | | 0.05 | N.B. | | | 0.04 |
| ADI-55696 | N.B. | | | 0.04 | N.B. | | | 0.04 |
| ADI-55697 | N.B. | | | 0.09 | 2.00E-07 | 8.72E+04 | 1.74E-02 | 0.26 |
| ADI-55698 | N.B. | | | 0.04 | N.B. | | | 0.02 |
| ADI-55699 | 8.70E-10 | 2.30E+05 | 2.00E-04 | 0.66 | 5.22E-10 | 3.98E+05 | 2.08E-04 | 0.56 |
| ADI-55700 | N.B. | | | 0.04 | N.B. | | | 0.04 |
| ADI-55701 | N.B. | | | 0.05 | N.B. | | | 0.02 |
| ADI-55702 | | | | | | | | |
| ADI-55703 | N.B. | | | 0.03 | N.B. | | | 0.01 |
| ADI-55704 | N.B. | | | 0.04 | N.B. | | | 0.05 |
| ADI-55705 | N.B. | | | 0.04 | N.B. | | | 0.02 |
| ADI-55706 | N.B. | | | 0.05 | N.B. | | | 0.04 |
| ADI-55707 | N.B. | | | 0.03 | N.B. | | | -0.02 |
| ADI-55708 | N.B. | | | 0.02 | N.B. | | | 0.04 |
| ADI-55709 | | | | | | | | |
| ADI-55710 | N.B. | | | 0.03 | N.B. | | | 0.02 |
| ADI-55711 | N.B. | | | 0.02 | N.B. | | | 0.01 |
| ADI-55712 | N.B. | | | 0.04 | N.B. | | | 0.02 |

FIG. 17A

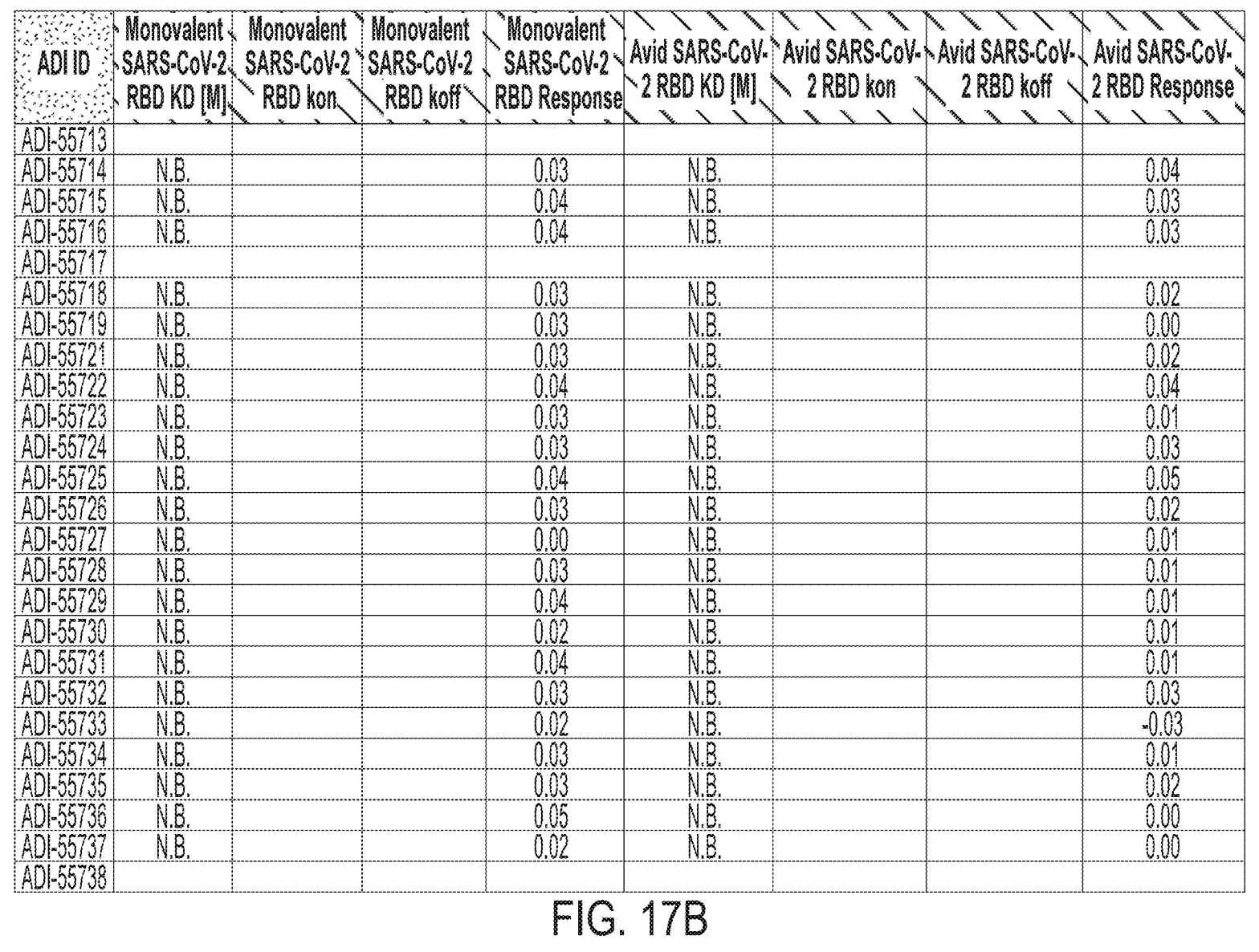

| ADI ID | Monovalent SARS-CoV-2 RBD KD [M] | Monovalent SARS-CoV-2 RBD kon | Monovalent SARS-CoV-2 RBD koff |

| ADI ID | Monovalent SARS-CoV-2 RBD KD [M] | Monovalent SARS-CoV-2 RBD kon | Monovalent SARS-CoV-2 RBD koff | Monovalent SARS-CoV-2 RBD Response | Avid SARS-CoV-2 RBD KD [M] | Avid SARS-CoV-2 RBD kon | Avid SARS-CoV-2 RBD koff | Avid SARS-CoV-2 RBD Response |
|---|---|---|---|---|---|---|---|---|
| ADI-55739 | N.B. | | | 0.03 | N.B. | | | 0.04 |
| ADI-55740 | N.B. | | | 0.03 | N.B. | | | 0.00 |
| ADI-55741 | N.B. | | | 0.03 | N.B. | | | -0.01 |
| ADI-55742 | N.B. | | | 0.03 | N.B. | | | 0.04 |
| ADI-55743 | | | | 0.04 | | | | 0.02 |
| ADI-55744 | | | | | | | | |
| ADI-55745 | N.B. | | | 0.03 | N.B. | | | 0.03 |
| ADI-55746 | N.B. | | | 0.04 | N.B. | | | 0.01 |
| ADI-55747 | N.B. | | | 0.03 | N.B. | | | 0.02 |
| ADI-55748 | N.B. | | | 0.03 | N.B. | | | 0.01 |
| ADI-55749 | 1.03E-09 | 1.94E+05 | 2.00E-04 | 0.58 | 5.60E-10 | 3.57E+05 | 2.00E-04 | 0.56 |
| ADI-55750 | N.B. | | | 0.03 | N.B. | | | 0.01 |
| ADI-55751 | N.B. | | | 0.02 | N.B. | | | 0.00 |
| ADI-55752 | N.B. | | | 0.03 | N.B. | | | 0.03 |
| ADI-55753 | N.B. | | | 0.03 | N.B. | | | -0.02 |
| ADI-55754 | 1.91E-09 | 2.14E+05 | 4.09E-04 | 0.57 | 8.73E-10 | 2.64E+05 | 2.31E-04 | 0.55 |
| ADI-55755 | N.B. | | | 0.02 | N.B. | | | 0.00 |
| ADI-55756 | N.B. | | | 0.03 | N.B. | | | 0.03 |
| ADI-55757 | 7.35E-09 | 1.81E+05 | 1.33E-03 | 0.12 | 7.22E-09 | 6.12E+04 | 4.42E-04 | 0.28 |
| ADI-55758 | N.B. | | | 0.03 | N.B. | | | 0.03 |
| ADI-55720 | | | | | | | | |
| ADI-55760 | N.B. | | | 0.02 | N.B. | | | 0.02 |
| ADI-55761 | N.B. | | | 0.01 | N.B. | | | 0.01 |
| ADI-55762 | N.B. | | | 0.03 | N.B. | | | 0.01 |
| ADI-55763 | N.B. | | | 0.03 | N.B. | | | 0.02 |

FIG. 17C

| ADI ID | Monovalent SARS-CoV-2 RBD KD [M] | Monovalent SARS-CoV-2 RBD kon | Monovalent SARS-CoV-2 RBD koff | Monovalent SARS-CoV-2 RBD Response | Avid SARS-CoV-2 RBD KD [M] | Avid SARS-CoV-2 RBD kon | Avid SARS-CoV-2 RBD koff | Avid SARS-CoV-2 RBD Response |
|---|---|---|---|---|---|---|---|---|
| ADI-55765 | N.B. | | | 0.02 | N.B. | | | 0.03 |
| ADI-55766 | N.B. | | | 0.04 | N.B. | | | 0.02 |
| ADI-55767 | N.B. | | | 0.02 | N.B. | | | 0.03 |
| ADI-55769 | N.B. | | | 0.02 | N.B. | | | -0.01 |
| ADI-55770 | N.B. | | | 0.04 | N.B. | | | 0.02 |
| ADI-55771 | 1.00E-06 | | | 0.13 | 1.00E-06 | | | 0.32 |
| ADI-55775 | N.B. | | | 0.02 | N.B. | | | 0.01 |
| ADI-55776 | N.B. | | | 0.02 | N.B. | | | 0.04 |
| ADI-55777 | N.B. | | | 0.04 | N.B. | | | 0.03 |
| ADI-55950 | N.B. | | | 0.05 | N.B. | | | 0.07 |
| ADI-55951 | 4.48E-08 | 2.39E+05 | 1.07E-02 | 0.48 | 1.23E-09 | 3.04E+05 | 3.75E-04 | 0.49 |
| ADI-55952 | N.B. | | | 0.06 | N.B. | | | 0.06 |
| ADI-55953 | N.B. | | | 0.06 | N.B. | | | 0.04 |
| ADI-55954 | N.B. | | | 0.05 | N.B. | | | 0.06 |
| ADI-55955 | N.B. | | | 0.04 | N.B. | | | 0.06 |
| ADI-55956 | N.B. | | | 0.05 | N.B. | | | 0.04 |
| ADI-55957 | N.B. | | | 0.05 | N.B. | | | 0.05 |
| ADI-55958 | 6.46E-09 | 3.58E+05 | 2.31E-03 | 0.36 | 2.28E-09 | 2.69E+05 | 6.14E-04 | 0.47 |
| ADI-55959 | N.B. | | | 0.05 | N.B. | | | 0.07 |
| ADI-55960 | N.B. | | | 0.04 | N.B. | | | 0.04 |
| ADI-55961 | N.B. | | | 0.08 | N.B. | | | 0.09 |
| ADI-55962 | N.B. | | | 0.05 | N.B. | | | 0.07 |
| ADI-55963 | N.B. | | | 0.05 | N.B. | | | 0.04 |
| ADI-55964 | N.B. | | | 0.05 | N.B. | | | 0.05 |
| ADI-55965 | N.B. | | | 0.07 | N.B. | | | 0.07 |

FIG. 17D

| ADI ID | Monovalent SARS-CoV-2 RBD KD [M] | Monovalent SARS-CoV-2 RBD kon | Monovalent SARS-CoV-2 RBD koff | Monovalent SARS-CoV-2 RBD Response | Avid SARS-CoV-2 RBD KD [M] | Avid SARS-CoV-2 RBD kon | Avid SARS-CoV-2 RBD koff | Avid SARS-CoV-2 RBD Response |
|---|---|---|---|---|---|---|---|---|
| ADI-55966 | N.B. | | | 0.04 | N.B. | | | 0.06 |
| ADI-55967 | N.B. | | | 0.06 | N.B. | | | 0.07 |
| ADI-55968 | N.B. | | | 0.06 | N.B. | | | 0.07 |
| ADI-55969 | N.B. | | | 0.06 | N.B. | | | 0.09 |
| ADI-55970 | N.B. | | | 0.05 | N.B. | | | 0.03 |
| ADI-55972 | N.B. | | | 0.05 | N.B. | | | 0.06 |
| ADI-55973 | N.B. | | | 0.04 | N.B. | | | 0.05 |
| ADI-55974 | N.B. | | | 0.05 | N.B. | | | 0.06 |
| ADI-55975 | N.B. | | | 0.04 | N.B. | | | 0.02 |
| ADI-55976 | N.B. | | | 0.06 | N.B. | | | 0.09 |
| ADI-55977 | 1.00E-06 | | | 0.20 | 4.03E-09 | 4.63E+05 | 1.87E-03 | 0.33 |
| ADI-55978 | N.B. | | | 0.04 | N.B. | | | 0.05 |
| ADI-55979 | N.B. | | | 0.04 | N.B. | | | 0.07 |
| ADI-55980 | N.B. | | | 0.06 | N.B. | | | 0.05 |
| ADI-55981 | N.B. | | | 0.04 | N.B. | | | 0.07 |
| ADI-55982 | N.B. | | | 0.04 | N.B. | | | 0.05 |
| ADI-55984 | N.B. | | | 0.05 | N.B. | | | 0.09 |
| ADI-55986 | N.B. | | | 0.05 | N.B. | | | 0.05 |
| ADI-55988 | N.B. | | | 0.06 | N.B. | | | 0.06 |
| ADI-55989 | N.B. | | | 0.05 | N.B. | | | 0.03 |
| ADI-55990 | N.B. | | | 0.06 | N.B. | | | 0.07 |
| ADI-55992 | N.B. | | | 0.05 | N.B. | | | 0.06 |
| ADI-55993 | 1.79E-08 | 1.05E+05 | 1.89E-03 | 0.43 | 1.12E-09 | 1.95E+05 | 2.19E-04 | 0.42 |
| ADI-55994 | N.B. | | | 0.07 | N.B. | | | 0.09 |
| ADI-55995 | N.B. | | | 0.05 | N.B. | | | 0.04 |

FIG. 17E

| ADI ID | Monovalent SARS-CoV-2 RBD KD [M] | Monovalent SARS-CoV-2 RBD kon | Monovalent SARS-CoV-2 RBD koff | Monovalent SARS-CoV-2 RBD Response | Avid SARS-CoV-2 RBD KD [M] | Avid SARS-CoV-2 RBD kon | Avid SARS-CoV-2 RBD koff | Avid SARS-CoV-2 RBD Response |
|---|---|---|---|---|---|---|---|---|
| ADI-55996 | N.B. | | | 0.04 | N.B. | | | 0.04 |
| ADI-55997 | N.B. | | | 0.05 | N.B. | | | 0.01 |
| ADI-55998 | N.B. | | | 0.02 | N.B. | | | 0.01 |
| ADI-55999 | N.B. | | | 0.05 | N.B. | | | 0.05 |
| ADI-56000 | 1.80E-08 | 1.08E+05 | 1.93E-03 | 0.45 | 9.13E-10 | 2.55E+05 | 2.33E-04 | 0.45 |
| ADI-56001 | N.B. | | | 0.04 | N.B. | | | 0.02 |
| ADI-56002 | N.B. | | | 0.04 | 1.00E-06 | | | 0.11 |
| ADI-56003 | N.B. | | | 0.05 | N.B. | | | 0.03 |
| ADI-56004 | N.B. | | | 0.06 | N.B. | | | 0.05 |
| ADI-56005 | N.B. | | | 0.04 | N.B. | | | 0.08 |
| ADI-56006 | N.B. | | | 0.05 | N.B. | | | 0.07 |
| ADI-56007 | 1.00E-06 | | | 0.21 | 1.00E-06 | | | 0.46 |
| ADI-56008 | N.B. | | | 0.04 | N.B. | | | 0.08 |
| ADI-56009 | N.B. | | | 0.04 | N.B. | | | 0.03 |
| ADI-56010 | 1.33E-09 | 5.13E+05 | 6.81E-04 | 0.69 | 3.32E-10 | 7.30E+05 | 2.42E-04 | 0.51 |
| ADI-56011 | N.B. | | | 0.04 | N.B. | | | 0.06 |
| ADI-56012 | N.B. | | | 0.05 | N.B. | | | 0.03 |
| ADI-56013 | N.B. | | | 0.03 | N.B. | | | 0.06 |
| ADI-56014 | N.B. | | | 0.04 | N.B. | | | 0.04 |
| ADI-56015 | N.B. | | | 0.06 | N.B. | | | 0.04 |
| ADI-56016 | N.B. | | | 0.04 | N.B. | | | 0.06 |
| ADI-56017 | N.B. | | | 0.04 | N.B. | | | 0.06 |
| ADI-56018 | N.B. | | | 0.04 | N.B. | | | 0.06 |
| ADI-56019 | N.B. | | | 0.03 | N.B. | | | 0.07 |
| ADI-56020 | 1.77E-09 | 1.94E+05 | 3.43E-04 | 0.57 | 5.42E-10 | 3.69E+05 | 2.00E-04 | 0.47 |

FIG. 17F

| ADI ID | Monovalent SARS-CoV-2 RBD KD [M] | Monovalent SARS-CoV-2 RBD kon | Monovalent SARS-CoV-2 RBD koff | Monovalent SARS-CoV-2 RBD Response | Avid SARS-CoV-2 RBD KD [M] | Avid SARS-CoV-2 RBD kon | Avid SARS-CoV-2 RBD koff | Avid SARS-CoV-2 RBD Response |
|---|---|---|---|---|---|---|---|---|
| ADI-56021 | N.B. | | | 0.04 | N.B. | | | 0.02 |
| ADI-56022 | N.B. | | | 0.07 | 1.00E-06 | | | 0.10 |
| ADI-56023 | N.B. | | | 0.05 | N.B. | | | 0.05 |
| ADI-56024 | N.B. | | | 0.04 | N.B. | | | 0.06 |
| ADI-56025 | N.B. | | | 0.05 | N.B. | | | 0.06 |
| ADI-56026 | N.B. | | | 0.04 | N.B. | | | -0.01 |
| ADI-56027 | N.B. | | | 0.06 | N.B. | | | 0.05 |
| ADI-56028 | N.B. | | | 0.05 | 1.00E-06 | | | 0.11 |
| ADI-56029 | N.B. | | | 0.04 | N.B. | | | 0.07 |
| ADI-56030 | N.B. | | | 0.07 | 1.00E-06 | | | 0.10 |
| ADI-56031 | N.B. | | | 0.05 | N.B. | | | 0.08 |
| ADI-56032 | N.B. | | | 0.04 | N.B. | | | 0.04 |
| ADI-56033 | N.B. | | | 0.04 | N.B. | | | 0.05 |
| ADI-56034 | N.B. | | | 0.04 | N.B. | | | 0.05 |
| ADI-56035 | 3.16E-07 | 9.59E+04 | 3.03E-02 | 0.37 | 1.73E-09 | 4.87E+05 | 8.44E-04 | 0.58 |
| ADI-56037 | N.B. | | | 0.06 | N.B. | | | 0.06 |
| ADI-56038 | N.B. | | | 0.04 | N.B. | | | 0.08 |
| ADI-56039 | N.B. | | | 0.05 | N.B. | | | 0.04 |
| ADI-56040 | 8.97E-09 | 2.48E+05 | 2.23E-03 | 0.52 | 7.89E-10 | 3.79E+05 | 2.99E-04 | 0.44 |
| ADI-56041 | N.B. | | | 0.05 | N.B. | | | 0.05 |
| ADI-56042 | N.B. | | | 0.03 | N.B. | | | 0.03 |
| ADI-56043 | N.B. | | | 0.04 | N.B. | | | 0.06 |
| ADI-56044 | N.B. | | | 0.04 | N.B. | | | 0.05 |
| ADI-56045 | N.B. | | | 0.03 | N.B. | | | 0.07 |
| ADI-56046 | 9.26E-10 | 6.95E+05 | 6.43E-04 | 0.55 | 6.01E-10 | 5.23E+05 | 3.14E-04 | 0.39 |

FIG. 17G

| ADI ID | Monovalent SARS-CoV-2 RBD KD [M] | Monovalent SARS-CoV-2 RBD kon | Monovalent SARS-CoV-2 RBD koff | Monovalent SARS-CoV-2 RBD Response | Avid SARS-CoV-2 RBD KD [M] | Avid SARS-CoV-2 RBD kon | Avid SARS-CoV-2 RBD koff | Avid SARS-CoV-2 RBD Response |
|---|---|---|---|---|---|---|---|---|
| ADI-56047 | N.B. | | | 0.02 | N.B. | | | 0.01 |
| ADI-56048 | N.B. | | | 0.02 | N.B. | | | 0.02 |
| ADI-56049 | N.B. | | | 0.02 | N.B. | | | 0.07 |
| ADI-56050 | N.B. | | | 0.02 | N.B. | | | 0.05 |
| ADI-56051 | 2.81E-08 | 1.39E+05 | 3.89E-03 | 0.14 | 1.16E-08 | 9.64E+04 | 1.12E-03 | 0.19 |
| ADI-56052 | N.B. | | | 0.02 | N.B. | | | 0.05 |
| ADI-56053 | 5.53E-08 | 2.13E+05 | 1.18E-02 | 0.11 | 9.68E-09 | 2.61E+05 | 2.53E-03 | 0.20 |
| ADI-56054 | N.B. | | | 0.01 | N.B. | | | 0.02 |
| ADI-56055 | N.B. | | | 0.04 | N.B. | | | 0.08 |
| ADI-56056 | N.B. | | | 0.02 | N.B. | | | 0.03 |
| ADI-56057 | N.B. | | | 0.03 | N.B. | | | 0.02 |
| ADI-56058 | 1.06E-07 | 1.22E+05 | 1.30E-02 | 0.24 | 4.26E-09 | 1.73E+05 | 7.37E-04 | 0.33 |
| ADI-56059 | N.B. | | | 0.02 | N.B. | | | 0.04 |
| ADI-56061 | N.B. | | | 0.02 | N.B. | | | 0.04 |
| ADI-56062 | N.B. | | | 0.02 | N.B. | | | 0.03 |
| ADI-56063 | N.B. | | | 0.04 | N.B. | | | 0.04 |
| ADI-56064 | N.B. | | | 0.02 | N.B. | | | 0.04 |
| ADI-56065 | N.B. | | | 0.02 | N.B. | | | 0.03 |
| ADI-56066 | N.B. | | | 0.02 | N.B. | | | 0.02 |
| ADI-56067 | N.B. | | | 0.03 | N.B. | | | 0.05 |
| ADI-56068 | N.B. | | | 0.05 | N.B. | | | 0.03 |
| ADI-56069 | N.B. | | | 0.05 | N.B. | | | 0.06 |
| ADI-56070 | N.B. | | | 0.01 | N.B. | | | 0.01 |
| ADI-56071 | 7.97E-08 | 2.73E+05 | 2.18E-02 | 0.37 | 2.59E-09 | 1.43E+05 | 3.71E-04 | 0.30 |
| ADI-56072 | N.B. | | | 0.03 | N.B. | | | 0.02 |

FIG. 17H

| ADI ID | Monovalent SARS-CoV-2 RBD KD [M] | Monovalent SARS-CoV-2 RBD kon | Monovalent SARS-CoV-2 RBD koff | Monovalent SARS-CoV-2 RBD Response | Avid SARS-CoV-2 RBD KD [M] | Avid SARS-CoV-2 RBD kon | Avid SARS-CoV-2 RBD koff | Avid SARS-CoV-2 RBD Response |
|---|---|---|---|---|---|---|---|---|
| ADI-56073 | N.B. | | | 0.01 | N.B. | | | 0.01 |
| ADI-56074 | N.B. | | | 0.03 | N.B. | | | 0.00 |
| ADI-56075 | N.B. | | | 0.03 | N.B. | | | 0.03 |
| ADI-56076 | N.B. | | | 0.03 | N.B. | | | 0.04 |
| ADI-56078 | N.B. | | | 0.06 | N.B. | | | 0.07 |
| ADI-56079 | N.B. | | | 0.02 | N.B. | | | 0.04 |
| ADI-56080 | N.B. | | | 0.03 | N.B. | | | 0.06 |
| ADI-56081 | N.B. | | | 0.03 | N.B. | | | 0.03 |
| ADI-56082 | N.B. | | | 0.04 | N.B. | | | 0.07 |
| ADI-56083 | N.B. | | | 0.05 | 1.00E-06 | | | 0.10 |
| ADI-56084 | N.B. | | | 0.07 | N.B. | | | 0.09 |

FIG. 17I

| ADI ID | SARS-CoV-2 NTD KD [M] | SARS-CoV-2 NTD kon | SARS-CoV-2 NTD koff | SARS-CoV-2 NTD Response |
|---|---|---|---|---|
| ADI-55688 | N.B. | | | 0.00 |
| ADI-55689 | N.B. | | | 0.01 |
| ADI-55690 | N.B. | | | 0.01 |
| ADI-55691 | N.B. | | | -0.01 |
| ADI-55692 | N.B. | | | 0.02 |
| ADI-55693 | | | | |
| ADI-55694 | N.B. | | | -0.01 |
| ADI-55695 | N.B. | | | 0.09 |
| ADI-55696 | 1.00E-06 | 2.19E+05 | 8.15E-03 | 0.13 |
| ADI-55697 | N.B. | | | 0.01 |
| ADI-55698 | N.B. | | | 0.05 |
| ADI-55699 | N.B. | | | -0.01 |
| ADI-55700 | N.B. | | | 0.06 |
| ADI-55701 | N.B. | | | 0.05 |
| ADI-55702 | N.B. | | | 0.00 |
| ADI-55703 | N.B. | | | 0.07 |
| ADI-55704 | N.B. | | | 0.02 |
| ADI-55705 | N.B. | | | 0.12 |
| ADI-55706 | 1.00E-06 | 2.79E+05 | 1.32E-04 | 0.27 |
| ADI-55707 | 3.15E-09 | 1.67E+05 | 5.27E-04 | 0.24 |
| ADI-55708 | 2.85E-09 | 2.26E+05 | 6.44E-04 | 0.23 |
| ADI-55809 | | | | |
| ADI-55710 | 4.42E-09 | 5.45E+05 | 2.41E-03 | 0.35 |
| ADI-55711 | 1.85E-09 | 3.24E+05 | 5.98E-03 | 0.04 |
| ADI-55712 | N.B. | | | |

| ADI ID | SARS-CoV-2 NTD KD [M] | SARS-CoV-2 NTD kon | SARS-CoV-2 NTD koff | SARS-CoV-2 NTD Response |
|---|---|---|---|---|
| ADI-55713 | | | | |
| ADI-55714 | N.B. | | | 0.02 |
| ADI-55715 | N.B. | | | 0.03 |
| ADI-55716 | 1.20E-08 | 2.36E+05 | 2.84E-03 | 0.28 |
| ADI-55717 | | | | |
| ADI-55718 | 4.84E-08 | 2.53E+05 | 1.23E-02 | 0.22 |
| ADI-55719 | 1.00E-06 | 8.25E+04 | 5.99E-04 | 0.18 |
| ADI-55721 | N.B. | | | 0.04 |
| ADI-55722 | N.B. | | | 0.04 |
| ADI-55723 | N.B. | | | 0.01 |
| ADI-55724 | N.B. | | | 0.03 |
| ADI-55725 | N.B. | | | 0.07 |
| ADI-55726 | N.B. | | | 0.01 |
| ADI-55727 | 2.10E-09 | 2.91E+05 | 6.12E-04 | 0.23 |
| ADI-55728 | N.B. | | | 0.02 |
| ADI-55729 | N.B. | | | 0.02 |
| ADI-55730 | 4.32E-08 | 2.42E+05 | 1.05E-02 | 0.35 |
| ADI-55731 | N.B. | | | 0.02 |
| ADI-55732 | N.B. | | | 0.02 |
| ADI-55733 | N.B. | | | 0.05 |
| ADI-55734 | 3.36E-09 | 2.03E+05 | 6.81E-04 | 0.31 |
| ADI-55735 | N.B. | | | 0.03 |
| ADI-55736 | N.B. | | | 0.03 |
| ADI-55737 | 2.77E-09 | 4.31E+05 | 1.20E-03 | 0.39 |
| ADI-55738 | | | | |

FIG. 18A

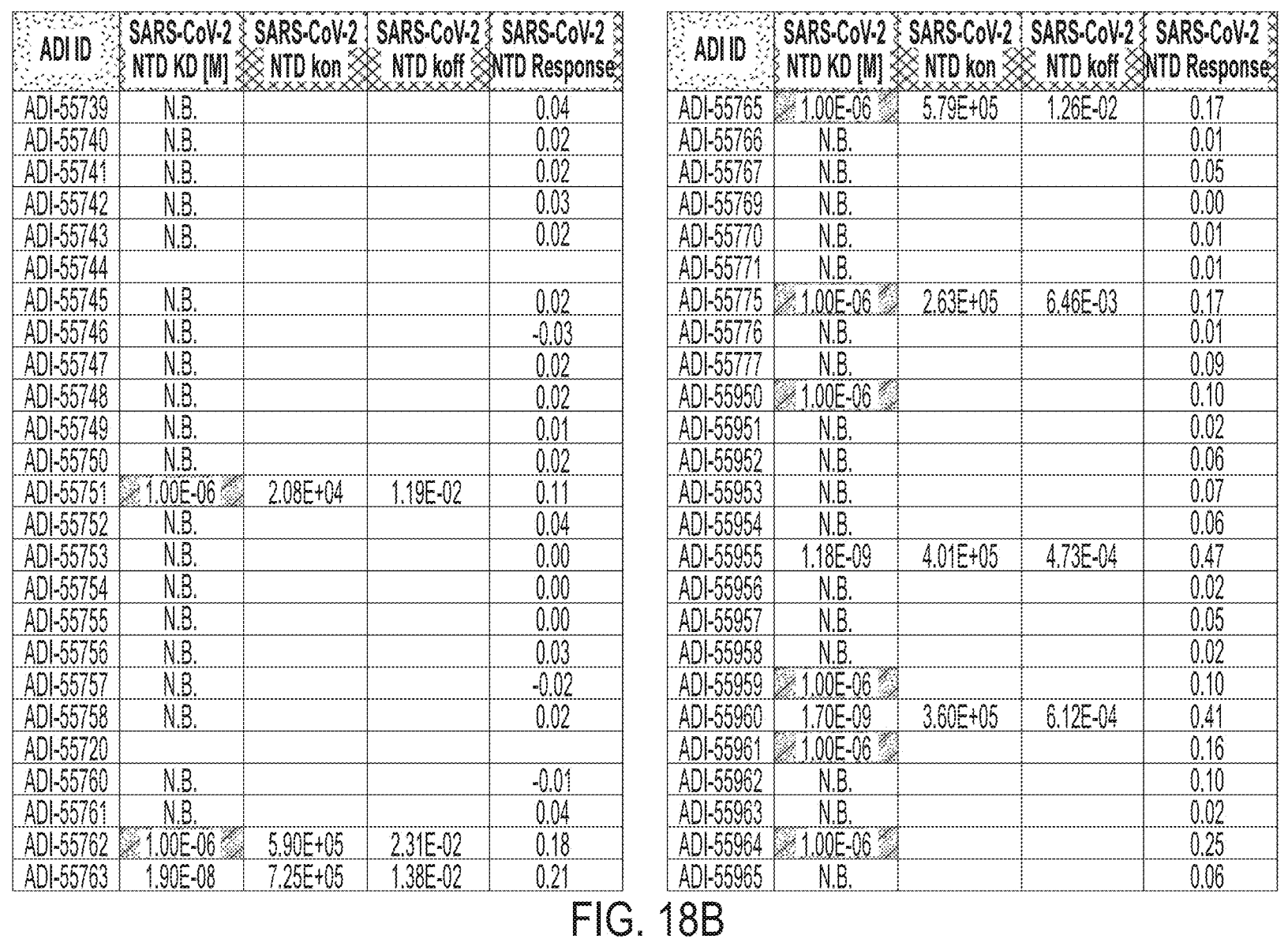

| ADI ID | SARS-CoV-2 NTD KD [M] | SARS-CoV-2 N

| ADI ID | SARS-CoV-2 NTD KD [M] | SARS-CoV-2 NTD kon | SARS-CoV-2 NTD koff | SARS-CoV-2 NTD Response |
|---|---|---|---|---|
| ADI-55966 | N.B. | | | 0.06 |
| ADI-55967 | N.B. | | | 0.08 |
| ADI-55968 | N.B. | | | 0.08 |
| ADI-55969 | 9.35E-10 | 1.01E+06 | 9.41E-04 | 0.48 |
| ADI-55970 | N.B. | | | 0.04 |
| ADI-55972 | 1.00E-06 | | | 0.11 |
| ADI-55973 | 1.00E-06 | | | 0.24 |
| ADI-55974 | N.B. | | | 0.10 |
| ADI-55975 | 1.00E-06 | | | 0.05 |
| ADI-55976 | N.B. | | | 0.15 |
| ADI-55977 | N.B. | | | 0.04 |
| ADI-55978 | 8.85E-10 | 4.71E+05 | 4.17E-04 | 0.54 |
| ADI-55979 | N.B. | | | 0.04 |
| ADI-55980 | 1.00E-06 | | | 0.11 |
| ADI-55981 | N.B. | | | 0.05 |
| ADI-55982 | N.B. | | | 0.06 |
| ADI-55984 | 1.00E-06 | 2.36E+05 | 1.37E-02 | 0.15 |
| ADI-55986 | N.B. | | | 0.03 |
| ADI-55988 | 3.79E-09 | 5.31E+05 | 2.01E-03 | 0.45 |
| ADI-55989 | N.B. | | | 0.02 |
| ADI-55990 | 1.00E-06 | | | 0.15 |
| ADI-55992 | N.B. | | | 0.02 |
| ADI-55993 | N.B. | | | 0.02 |
| ADI-55994 | N.B. | | | 0.01 |
| ADI-55995 | N.B. | | | 0.08 |
| ADI-55996 | N.B. | | | 0.07 |
| ADI-55997 | 8.58E-09 | 2.11E+05 | 1.81E-03 | 0.22 |
| ADI-55998 | 4.04E-09 | 1.59E+05 | 6.44E-04 | 0.38 |
| ADI-55999 | N.B. | | | 0.02 |
|

| ADI ID | SARS-CoV-2 NTD KD [M] | SARS-CoV-2 NTD kon | SARS-CoV-2 NTD koff | SARS-CoV-2 NTD Response |
|---|---|---|---|---|
| ADI-56021 | N.B. | | | 0.04 |
| ADI-56022 | 1.00E-06 | 1.44E+05 | 1.65E-02 | 0.15 |
| ADI-56023 | N.B. | | | 0.08 |
| ADI-56024 | 4.25E-09 | 3.59E+05 | 1.53E-03 | 0.35 |
| ADI-56025 | N.B. | | | 0.09 |
| ADI-56026 | 4.66E-09 | 3.14E+05 | 1.46E-03 | 0.36 |
| ADI-56027 | N.B. | | | 0.09 |
| ADI-56028 | 1.00E-06 | 2.16E+05 | 1.30E-02 | 0.20 |
| ADI-56029 | N.B. | | | 0.09 |
| ADI-56030 | 1.00E-06 | | | 0.19 |
| ADI-56031 | 1.00E-06 | 3.00E+02 | 1.18E-02 | 0.13 |
| ADI-56032 | 3.06E-08 | 3.93E+02 | 1.20E-02 | 0.29 |
| ADI-56033 | N.B. | | | 0.03 |
| ADI-56034 | N.B. | | | 0.03 |
| ADI-56035 | N.B. | | | 0.03 |
| ADI-56037 | N.B. | | | 0.08 |
| ADI-56038 | 1.00E-06 | 1.75E+05 | 1.60E-02 | 0.12 |
| ADI-56039 | N.B. | | | 0.05 |
| ADI-56040 | N.B. | | | 0.01 |
| ADI-56041 | N.B. | | | 0.06 |
| ADI-56042 | 3.20E-09 | 1.99E+05 | 6.36E-04 | 0.38 |
| ADI-56043 | N.B. | | | 0.04 |
| ADI-56044 | N.B. | | | 0.06 |
| ADI-56045 | 1.00E-06 | | | 0.15 |
| ADI-56046 | N.B. | | | 0.02 |
| ADI-56047 | N.B. | | | 0.00 |
| ADI-56048 | N.B. | | | 0.05 |
| ADI-56049 | 1.00E-06 | 1.21E+05 | 1.35E-02 | 0.13 |
| ADI-56050 | 1.00E-06 | 1.25E+05 | 2.13E-02 | 0.11 |
| ADI-56051 | N.B. | | | 0.01 |
| ADI-56052 | N.B. | | | 0.08 |
| ADI-56053 | N.B. | | | 0.04 |
| ADI-56054 | N.B. | | | 0.02 |
| ADI-56055 | 1.00E-06 | 2.27E+05 | 1.35E-02 | 0.19 |
| ADI-56056 | N.B. | | | 0.05 |
| ADI-56057 | N.B. | | | 0.04 |
| ADI-56058 | N.B. | | | 0.02 |
| ADI-56059 | N.B. | | | 0.03 |
| ADI-56061 | N.B. | | | 0.07 |
| ADI-56062 | N.B. | | | 0.07 |
| ADI-56063 | N.B. | | | 0.07 |
| ADI-56064 | 1.00E-06 | | | 0.11 |
| ADI-56065 | 6.15E-09 | 1.43E+05 | 8.82E-04 | 0.27 |
| ADI-56066 | 1.00E-06 | 6.52E+04 | 2.42E-03 | 0.11 |
| ADI-56067 | 1.00E-06 | | | 0.11 |
| ADI-56068 | 1.00E-06 | 1.31E+05 | 1.47E-03 | 0.13 |
| ADI-56069 | 1.00E-06 | | | 0.13 |
| ADI-56070 | 1.00E-06 | 1.51E+05 | 1.74E-03 | 0.20 |
| ADI-56071 | N.B. | | | 0.02 |
| ADI-56072 | N.B. | | | 0.03 |

FIG. 18D

| ADID | SARS-CoV-2 NTD KD [M] | SARS-CoV-2 NTD Kon | SARS-CoV-2 NTD koff | SARS-CoV-2 NTD Response |
|---|---|---|---|---|
| ADI-56073 | N.B. | | | 0.02 |
| ADI-56074 | 1.00E-06 | 1.04E+05 | 7.39E-04 | 0.20 |
| ADI-56075 | N.B. | | | 0.04 |
| ADI-56076 | N.B. | | | 0.09 |
| ADI-56078 | N.B. | | | 0.00 |
| ADI-56079 | N.B. | | | 0.06 |
| ADI-56080 | N.B. | | | 0.08 |
| ADI-56081 | 1.06E-09 | 4.03E+05 | 4.28E-04 | 0.34 |
| ADI-56082 | N.B. | | | 0.03 |
| ADI-56083 | 1.00E-06 | | | 0.11 |
| ADI-56084 | 1.00E-06 | 1.60E+05 | 1.15E-02 | 0.13 |

FIG. 18E

| ADI ID | SARS-CoV-2 RBD binder? | SARS-CoV-2 NTD | Monovalent SARS-CoV-2 S1 subunit binder? | AVID SARS-CoV-2 S1 subunit binder? | SARS-CoV-2 S2 binder? |
|---|---|---|---|---|---|
| ADI-55688 | Yes | No | Yes | Yes | No |
| ADI-55689 | Yes | No | Yes | Yes | No |
| ADI-55690 | Yes | No | Yes | Yes | No |
| ADI-55691 | No | No | | | No |
| ADI-55692 | Yes | No | Yes | Yes | No |
| ADI-55693 | | | | | |
| ADI-55694 | Yes | No | Yes | Yes | No |
| ADI-55695 | No | No | | | No |
| ADI-55696 | No | No | | | No |
| ADI-55697 | Yes | No | | Yes | No |
| ADI-55698 | No | No | | | No |
| ADI-55699 | Yes | No | Yes | Yes | No |
| ADI-55700 | No | No | | | No |
| ADI-55701 | No | No | | | No |
| ADI-55702 | | | | | |
| ADI-55703 | No | No | | No | Yes |
| ADI-55704 | No | No | | | No |
| ADI-55705 | No | No | | | No |
| ADI-55706 | No | No | | | No |
| ADI-55707 | No | Yes | Yes | Yes | No |
| ADI-55708 | No | Yes | Yes | Yes | No |
| ADI-55709 | | | | | |
| ADI-55710 | No | Yes | | Yes | No |
| ADI-55711 | No | Yes | Yes | Yes | No |
| ADI-55712 | No | No | | | No |

FIG. 19A

| ADI ID | SARS-CoV-2 RBD binder? | SARS-CoV-2 NTD | Monovalent SARS-CoV-2 S1 subunit binder? | AVID SARS-CoV-2 S1 subunit binder? | SARS-CoV-2 S2 binder? |
|---|---|---|---|---|---|
| ADI-55713 | | | | | |
| ADI-55714 | No | No | | | No |
| ADI-55715 | No | No | | | No |
| ADI-55716 | No | Yes | | Yes | No |
| ADI-55717 | | | | | |
| ADI-55718 | No | Yes | | Yes | No |
| ADI-55719 | No | Yes | | Yes | No |
| ADI-55721 | No | No | | | No |
| ADI-55722 | No | No | | | No |
| ADI-55723 | No | No | | | No |
| ADI-55724 | No | No | | No | Yes |
| ADI-55725 | No | No | | | No |
| ADI-55726 | No | No | | | No |
| ADI-55727 | No | Yes | Yes | Yes | No |
| ADI-55728 | No | No | | | No |
| ADI-55729 | No | No | | | No |
| ADI-55730 | No | Yes | | Yes | No |
| ADI-55731 | No | No | | | No |
| ADI-55732 | No | No | | No | Yes |
| ADI-55733 | No | No | | | No |
| ADI-55734 | No | Yes | Yes | Yes | No |
| ADI-55735 | No | No | | | No |
| ADI-55736 | No | No | | | No |
| ADI-55737 | No | Yes | Yes | Yes | No |
| ADI-55738 | | | | | |

FIG. 19B

| ADI ID | SARS-CoV-2 RBD binder? | SARS-CoV-2 NTD | Monovalent SARS-CoV-2 S1 subunit binder? | AVID SARS-CoV-2 S1 subunit binder? | SARS-CoV-2 S2 binder? |
|---|---|---|---|---|---|
| ADI-55739 | No | No | | | No |
| ADI-55740 | No | No | | | No |
| ADI-55741 | No | No | | | No |
| ADI-55742 | No | No | | | No |
| ADI-55743 | No | No | | | No |
| ADI-55744 | | | | | |
| ADI-55745 | No | No | | | No |
| ADI-55746 | No | No | | No | Yes |
| ADI-55747 | No | No | | | No |
| ADI-55748 | No | No | | | No |
| ADI-55749 | Yes | No | Yes | Yes | No |
| ADI-55750 | No | No | | | No |
| ADI-55751 | No | Yes | | Yes | No |
| ADI-55752 | No | No | | | No |
| ADI-55753 | No | No | | | No |
| ADI-55754 | Yes | No | Yes | Yes | No |
| ADI-55755 | No | No | | | No |
| ADI-55756 | No | No | | | No |
| ADI-55757 | Yes | No | Yes | Yes | No |
| ADI-55758 | No | No | | | No |
| ADI-55720 | | | | | |
| ADI-55760 | No | No | | | No |
| ADI-55761 | No | No | | | No |
| ADI-55762 | No | Yes | | Yes | No |
| ADI-55763 | No | Yes | | Yes | No |

FIG. 19C

| ADI ID | SARS-CoV-2 RBD binder? | SARS-CoV-2 NTD | Monovalent SARS-CoV-2 S1 subunit binder? | AVID SARS-CoV-2 S1 subunit binder? | SARS-CoV-2 S2 binder? |
|---|---|---|---|---|---|
| ADI-55765 | No | Yes | | Yes | No |
| ADI-55766 | No | No | | | No |
| ADI-55767 | No | No | | | No |
| ADI-55769 | No | No | | | No |
| ADI-55770 | No | No | | | No |
| ADI-55771 | Yes | No | | Yes | No |
| ADI-55775 | No | Yes | | Yes | No |
| ADI-55776 | No | No | | | No |
| ADI-55777 | No | No | | | No |
| ADI-55950 | No | No | | | No |
| ADI-55951 | Yes | No | Yes | Yes | No |
| ADI-55952 | No | No | | | No |
| ADI-55953 | No | No | | | No |
| ADI-55954 | No | No | | | No |
| ADI-55955 | No | Yes | Yes | Yes | No |
| ADI-55956 | No | No | | | No |
| ADI-55957 | No | No | | | No |
| ADI-55958 | Yes | No | Yes | Yes | No |
| ADI-55959 | No | No | | | No |
| ADI-55960 | No | Yes | | Yes | No |
| ADI-55961 | No | No | | | No |
| ADI-55962 | No | No | | | No |
| ADI-55963 | No | No | | | No |
| ADI-55964 | No | Yes | | Yes | No |
| ADI-55965 | No | No | | | No |

FIG. 19D

| ADI ID | SARS-CoV-2 RBD binder? | SARS-CoV-2 NTD | Monovalent SARS-CoV-2 S1 subunit binder? | AVID SARS-CoV-2 S1 subunit binder? | SARS-CoV-2 S2 binder? |
|---|---|---|---|---|---|
| ADI-55966 | No | No | | | No |
| ADI-55967 | No | No | | | No |
| ADI-55968 | No | No | | | No |
| ADI-55969 | No | Yes | | Yes | No |
| ADI-55970 | No | No | | | No |
| ADI-55972 | No | No | | | No |
| ADI-55973 | No | Yes | | Yes | No |
| ADI-55974 | No | No | | | No |
| ADI-55975 | No | No | | | No |
| ADI-55976 | No | No | | | No |
| ADI-55977 | Yes | No | | Yes | No |
| ADI-55978 | No | Yes | Yes | Yes | No |
| ADI-55979 | No | No | | | No |
| ADI-55980 | No | No | | | No |
| ADI-55981 | No | No | | | No |
| ADI-55982 | No | No | | | No |
| ADI-55984 | No | No | | | No |
| ADI-55986 | No | No | | | No |
| ADI-55988 | No | Yes | | Yes | No |
| ADI-55989 | No | No | | No | Yes |
| ADI-55990 | No | No | | | No |
| ADI-55992 | No | No | | No | Yes |
| ADI-55993 | Yes | No | Yes | Yes | No |
| ADI-55994 | No | No | | No | Yes |
| ADI-55995 | No | No | | | No |

FIG. 19E

| ADI ID | SARS-CoV-2 RBD binder? | SARS-CoV-2 NTD | Monovalent SARS-CoV-2 S1 subunit binder? | AVID SARS-CoV-2 S1 subunit binder? | SARS-CoV-2 S2 binder? |
|---|---|---|---|---|---|
| ADI-55996 | No | No | | | No |
| ADI-55997 | No | Yes | | Yes | No |
| ADI-55998 | No | Yes | Yes | Yes | No |
| ADI-55999 | No | No | | | No |
| ADI-56000 | Yes | No | Yes | Yes | No |
| ADI-56001 | No | No | | No | Yes |
| ADI-56002 | No | No | | | No |
| ADI-56003 | No | Yes | | Yes | No |
| ADI-56004 | No | Yes | | Yes | No |
| ADI-56005 | No | No | | No | Yes |
| ADI-56006 | No | No | | No | Yes |
| ADI-56007 | Yes | No | | Yes | No |
| ADI-56008 | No | No | | | No |
| ADI-56009 | No | Yes | | Yes | No |
| ADI-56010 | Yes | No | Yes | Yes | No |
| ADI-56011 | No | Yes | Yes | Yes | No |
| ADI-56012 | No | Yes | | | No |
| ADI-56013 | No | No | | | No |
| ADI-56014 | No | Yes | | Yes | No |
| ADI-56015 | No | No | | | No |
| ADI-56016 | No | No | | No | Yes |
| ADI-56017 | No | Yes | | Yes | No |
| ADI-56018 | No | No | | | No |
| ADI-56019 | No | No | | | No |
| ADI-56020 | Yes | No | Yes | Yes | No |

FIG. 19F

| ADI ID | SARS-CoV-2 RBD binder? | SARS-CoV-2 NTD | Monovalent SARS-CoV-2 S1 subunit binder? | AVID SARS-CoV-2 S1 subunit binder? | SARS-CoV-2 S2 binder? |
|---|---|---|---|---|---|
| ADI-56021 | No | No | | | No |
| ADI-56022 | No | No | | | No |
| ADI-56023 | No | No | | | No |
| ADI-56024 | No | Yes | | Yes | No |
| ADI-56025 | No | No | | | No |
| ADI-56026 | No | Yes | | Yes | No |
| ADI-56027 | No | No | | | No |
| ADI-56028 | No | No | | | No |
| ADI-56029 | No | No | | | No |
| ADI-56030 | No | No | | | No |
| ADI-56031 | No | No | | | No |
| ADI-56032 | No | Yes | | Yes | No |
| ADI-56033 | No | No | | No | Yes |
| ADI-56034 | No | No | | No | Yes |
| ADI-56035 | Yes | No | Yes | Yes | No |
| ADI-56037 | No | No | | | No |
| ADI-56038 | No | No | | | No |
| ADI-56039 | No | No | | | No |
| ADI-56040 | Yes | No | Yes | Yes | No |
| ADI-56041 | No | No | | | No |
| ADI-56042 | No | Yes | | Yes | No |
| ADI-56043 | No | No | | No | Yes |
| ADI-56044 | No | No | | | No |
| ADI-56045 | No | No | | | No |
| ADI-56046 | Yes | No | Yes | Yes | No |

FIG. 19G

| ADI ID | SARS-CoV-2 RBD binder? | SARS-CoV-2 NTD | Monovalent SARS-CoV-2 S1 subunit binder? | AVID SARS-CoV-2 S1 subunit binder? | SARS-CoV-2 S2 binder? |
|---|---|---|---|---|---|
| ADI-56047 | No | No | | | No |
| ADI-56048 | No | No | | | No |
| ADI-56049 | No | No | | | No |
| ADI-56050 | No | No | | | No |
| ADI-56051 | Yes | No | | Yes | No |
| ADI-56052 | No | No | | | No |
| ADI-56053 | Yes | No | | Yes | No |
| ADI-56054 | No | No | | | No |
| ADI-56055 | No | No | | | No |
| ADI-56056 | No | No | | | No |
| ADI-56057 | No | No | | | No |
| ADI-56058 | Yes | No | | Yes | No |
| ADI-56059 | No | No | | No | Yes |
| ADI-56061 | No | No | | | No |
| ADI-56062 | No | No | | | No |
| ADI-56063 | No | No | | | No |
| ADI-56064 | No | No | | | No |
| ADI-56065 | No | Yes | | Yes | No |
| ADI-56066 | No | Yes | | Yes | No |
| ADI-56067 | No | No | | | No |
| ADI-56068 | No | Yes | | Yes | No |
| ADI-56069 | No | No | | | No |
| ADI-56070 | No | Yes | | Yes | No |
| ADI-56071 | Yes | No | Yes | Yes | No |
| ADI-56072 | No | No | | | No |

FIG. 19H

| ADI ID | SARS-CoV-2 RBD binder? | SARS-CoV-2 NTD | Monovalent SARS-CoV-2 S1 subunit binder? | AVID SARS-CoV-2 S1 subunit binder? | SARS-CoV-2 S2 binder? |
|---|---|---|---|---|---|
| ADI-56073 | No | No | | No | Yes |
| ADI-56074 | No | Yes | | Yes | No |
| ADI-56075 | No | No | | | No |
| ADI-56076 | No | No | | | No |
| ADI-56078 | No | No | | | No |
| ADI-56079 | No | No | | | No |
| ADI-56080 | No | No | | | No |
| ADI-56081 | No | Yes | Yes | Yes | No |
| ADI-56082 | No | No | | | No |
| ADI-56083 | No | Yes | | Yes | No |
| ADI-56084 | No | Yes | | Yes | No |

FIG. 19I

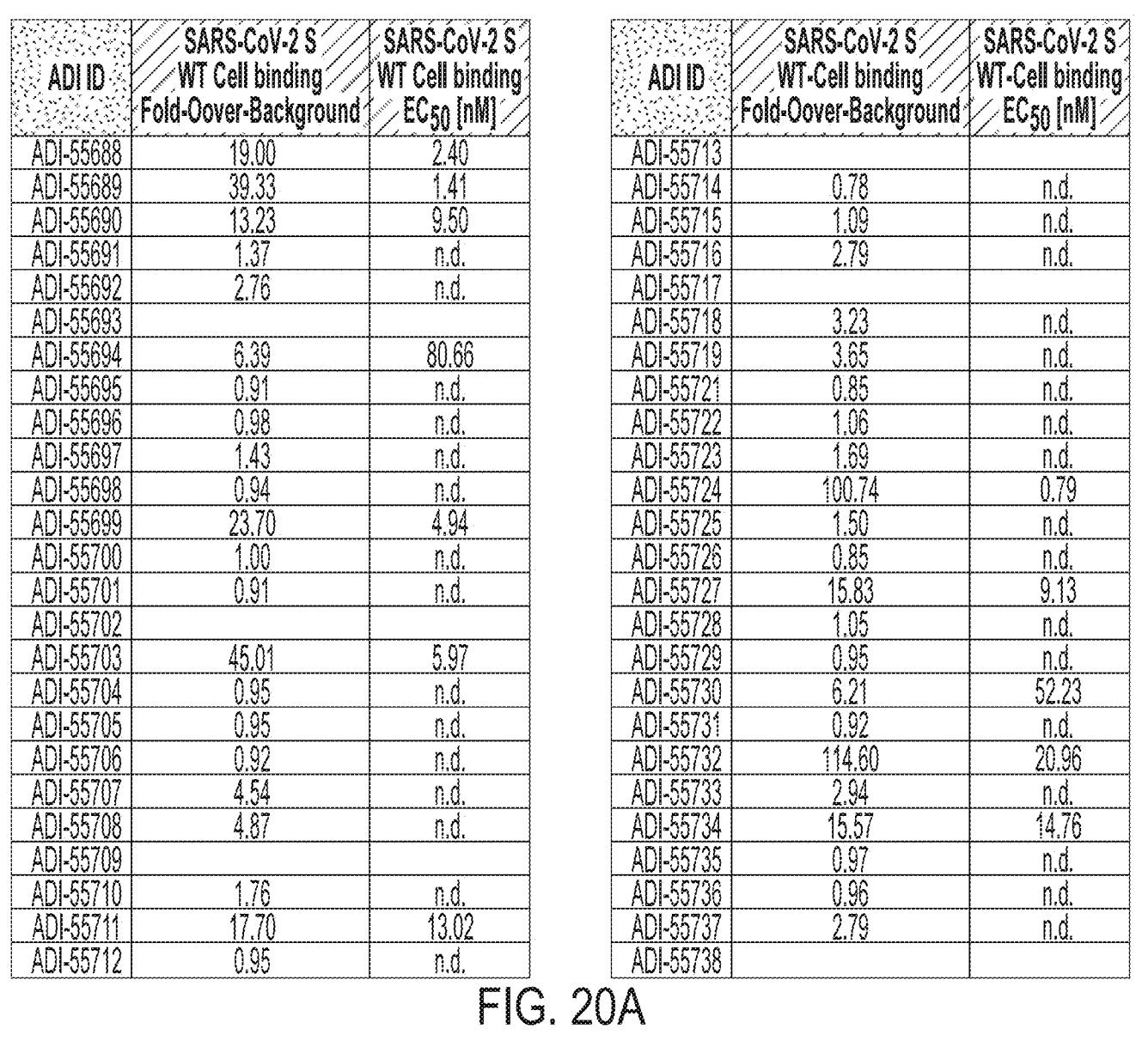

| ADI ID | SARS-CoV-2 S WT Cell binding Fold-Over-Background | SARS-CoV-2 S WT Cell binding EC50 [nM] | |

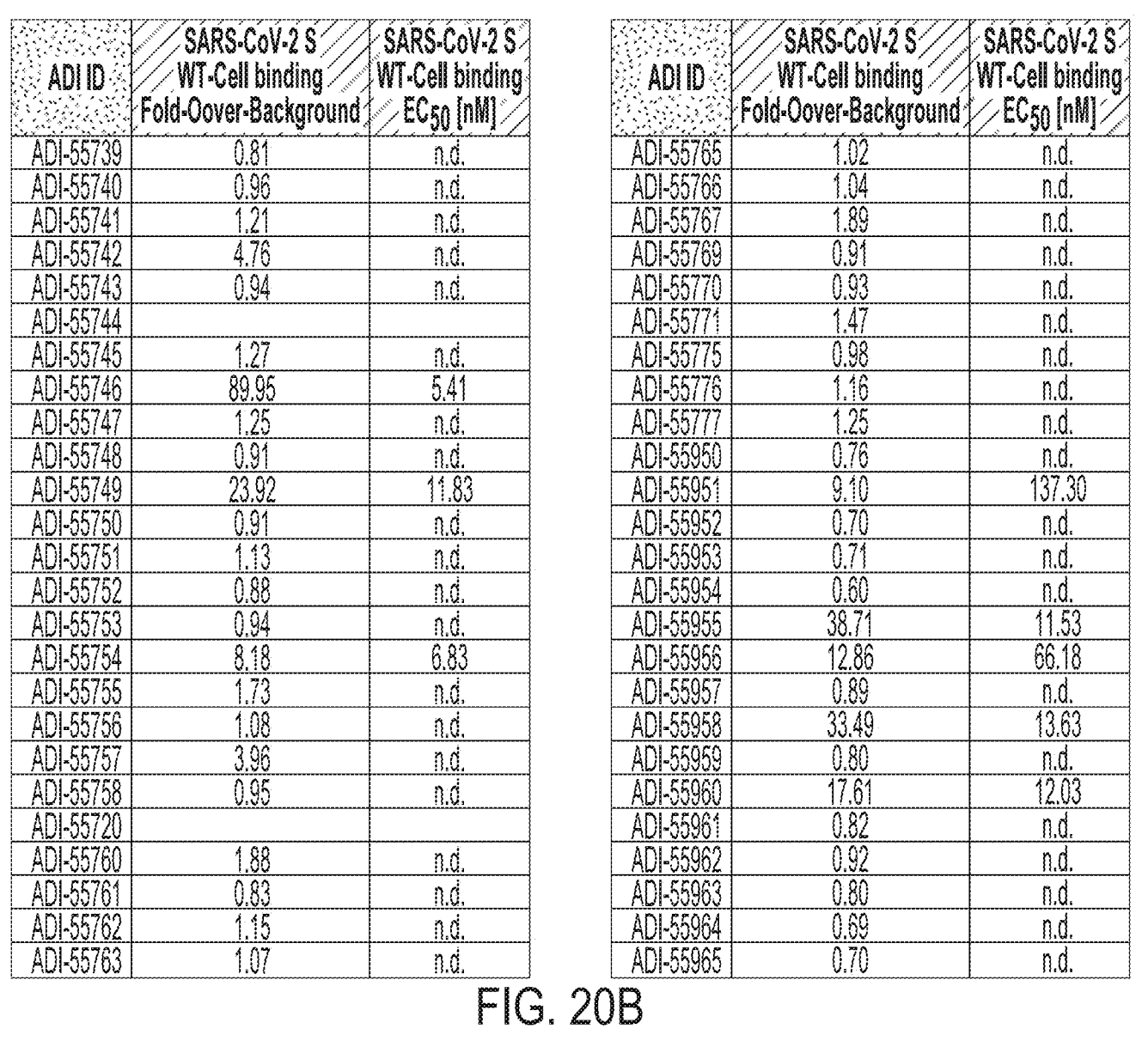

| AD ID | SARS-CoV-2 S WT-Cell binding Fold-Over-Background | SARS-CoV-2 S WT-Cell binding EC50 [nM] |
|---|---|---|
| ADI-55739 | 0.81 | n.d. |
| ADI-55740 | 0.96 | n.d. |
| ADI-55741 | 1.21 | n.d. |
| ADI-55742 | 4.76 | n.d. |
| ADI-55743 | 0.94 | n.d. |
| ADI-55744 |

| AD ID | SARS-CoV-2 S WT-Cell binding Fold-Over-Background | SARS-CoV-2 S WT-Cell binding EC50 [nM] |
|---|---|---|
| ADI-55966 | 0.78 | n.d. |
| ADI-55967 | 1.42 | n.d. |
| ADI-55968 | 0.74 | n.d. |
| ADI-55969 | 25.25 | 8.58 |
| ADI-55970 | 0.73 | n.d. |
| ADI-55972 | 1.50 | n.d. |
| ADI-55973 | 0.85 | n.d. |
| ADI-55974 | 1.56 | n.d. |
| ADI-55975 | 1.85 | n.d. |
| ADI-55976 | 0.78 | n.d. |
| ADI-55977 | 1.54 | n.d. |
| ADI-55978 | 29.92 | 6.96 |
| ADI-55979 | 0.97 | n.d. |
| ADI-55980 | 0.68 | n.d. |
| ADI-55981 | 0.93 | n.d. |
| ADI-55982 | 0.79 | n.d. |
| ADI-55984 | 1.15 | n.d. |
| ADI-55986 | 1.01 | n.d. |
| ADI-55988 | 18.98 | 97.94 |
| ADI-55989 | 45.70 | 2.21 |
| ADI-55990 | 0.81 | n.d. |
| ADI-55992 | 164.05 | 2.13 |
| ADI-55993 | 91.26 | 16.96 |
| ADI-55994 | 67.53 | 6.90 |
| ADI-55995 | 2.26 | n.d. |

| AD ID | SARS-CoV-2 S WT-Cell binding Fold-Over-Background | SARS-CoV-2 S WT-Cell binding EC50 [nM] |
|---|---|---|
| ADI-55996 | 1.02 | n.d. |
|

| ADI ID | SARS-CoV-2 S WT-Cell binding Fold-Oover-Background | SARS-CoV-2 S WT-Cell binding $EC_{50}$ [nM] |
|---|---|---|
| ADI-56021 | 0.79 | n.d. |
| ADI-56022 | 1.31 | n.d. |
| ADI-56023 | 1.00 | n.d. |
| ADI-56024 | 1.19 | n.d. |
| ADI-56025 | 0.90 | n.d. |
| ADI-56026 | 2.36 | n.d. |
| ADI-56027 | 1.03 | n.d. |
| ADI-56028 | 0.97 | n.d. |
| ADI-56029 | 1.03 | n.d. |
| ADI-56030 | 1.09 | n.d. |
| ADI-56031 | 1.36 | n.d. |
| ADI-56032 | 18.44 | 15.18 |
| ADI-56033 | 183.48 | 18.52 |
| ADI-56034 | 127.62 | 4.74 |
| ADI-56035 | 9.19 | 49.69 |
| ADI-56037 | 1.15 | n.d. |
| ADI-56038 | 1.06 | n.d. |
| ADI-56039 | 1.44 | n.d. |
| ADI-56040 | 44.46 | 0.61 |
| ADI-56041 | 0.98 | n.d. |
| ADI-56042 | 6.66 | 23.64 |
| ADI-56043 | 141.53 | 0.28 |
| ADI-56044 | 4.15 | n.d. |
| ADI-56045 | 1.31 | n.d. |
| ADI-56046 | 74.67 | 0.82 |

| ADI ID | SARS-CoV-2 S WT-Cell binding Fold-Oover-Background | SARS-CoV-2 S WT-Cell binding $EC_{50}$ [nM] |
|---|---|---|
| ADI-56047 | 2.73 | n.d. |
| ADI-56048 | 1.18 | n.d. |
| ADI-56049 | 1.03 | n.d. |
| ADI-56050 | 1.09 | n.d. |
| ADI-56051 | 6.76 | n.d. |
| ADI-56052 | 0.77 | n.d. |
| ADI-56053 | 1.85 | n.d. |
| ADI-56054 | 8.66 | 8.57 |
| ADI-56055 | 1.06 | n.d. |
| ADI-56056 | 0.99 | n.d. |
| ADI-56057 | 1.00 | n.d. |
| ADI-56058 | 27.36 | n.d. |
| ADI-56059 | 225.54 | 1.29 |
| ADI-56061 | 1.04 | n.d. |
| ADI-56062 | 0.97 | n.d. |
| ADI-56063 | 1.28 | n.d. |
| ADI-56064 | 1.01 | n.d. |
| ADI-56065 | 5.01 | n.d. |
| ADI-56066 | 1.32 | n.d. |
| ADI-56067 | 1.02 | n.d. |
| ADI-56068 | 0.93 | n.d. |
| ADI-56069 | 1.05 | n.d. |
| ADI-56070 | 1.30 | n.d. |
| ADI-56071 | 62.43 | 6.32 |
| ADI-56072 | 1.10 | n.d. |

FIG. 20D

| ADI ID | SARS-CoV-2 S WT-Cell binding Fold-Over-Background | SARS-CoV-2 S WT-Cell binding EC50 [nM] |
|

| ADI ID | ACE-2 competitor? | CR3022 competitor? |
|---|---|---|
| ADI-55688 | Yes | No |
| ADI-55689 | Yes | No |
| ADI-55690 | Yes | Yes |
| ADI-55691 | N/A | N/A |
| ADI-55692 | No | No |
| ADI-55693 | | |
| ADI-55694 | No | No |
| ADI-55695 | N/A | N/A |
| ADI-55696 | N/A | N/A |
| ADI-55697 | No | No |
| ADI-55698 | N/A | N/A |
| ADI-55699 | No | No |
| ADI-55700 | N/A | N/A |
| ADI-55701 | N/A | N/A |
| ADI-55702 | N/A | N/A |
| ADI-55703 | N/A | N/A |
| ADI-55704 | N/A | N/A |
| ADI-55705 | N/A | N/A |
| ADI-55706 | N/A | N/A |
| ADI-55707 | N/A | N/A |
| ADI-55708 | N/A | N/A |
| ADI-55709 | N/A | N/A |
| ADI-55710 | N/A | N/A |
| ADI-55711 | N/A | N/A |
| ADI-55712 | N/A | N/A |

| ADI ID | ACE-2 competitor? | CR3022 competitor? |
|---|---|---|
| ADI-55713 | | |
| ADI-55714 | N/A | N/A |
| ADI-55715 | N/A | N/A |
| ADI-55716 | N/A | N/A |
| ADI-55717 | | |
| ADI-55718 | N/A | N/A |
| ADI-55719 | N/A | N/A |
| ADI-55721 | N/A | N/A |
| ADI-55722 | N/A | N/A |
| ADI-55723 | N/A | N/A |
| ADI-55724 | N/A | N/A |
| ADI-55725 | N/A | N/A |
| ADI-55726 | N/A | N/A |
| ADI-55727 | N/A | N/A |
| ADI-55728 | N/A | N/A |
| ADI-55729 | N/A | N/A |
| ADI-55730 | N/A | N/A |
| ADI-55731 | N/A | N/A |
| ADI-55732 | N/A | N/A |
| ADI-55733 | N/A | N/A |
| ADI-55734 | N/A | N/A |
| ADI-55735 | N/A | N/A |
| ADI-55736 | N/A | N/A |
| ADI-55737 | N/A | N/A |
| ADI-55738 | | |

FIG. 21A

| ADI ID | ACE-2 competitor? | CR3022 competitor? |
|---|---|---|
| ADI-55739 | N/A | N/A |
| ADI-55740 | N/A | N/A |
| ADI-55741 | N/A | N/A |
| ADI-55742 | N/A | N/A |
| ADI-55743 | N/A | |
| ADI-55744 | | |
| ADI-55745 | N/A | N/A |
| ADI-55746 | N/A | N/A |
| ADI-55747 | N/A | N/A |
| ADI-55748 | N/A | N/A |
| ADI-55749 | No | Yes |
| ADI-55750 | N/A | N/A |
| ADI-55751 | N/A | N/A |
| ADI-55752 | N/A | N/A |
| ADI-55753 | N/A | N/A |
| ADI-55754 | No | Yes |
| ADI-55755 | N/A | N/A |
| ADI-55756 | N/A | N/A |
| ADI-55757 | No | No |
| ADI-55758 | N/A | N/A |
| ADI-55720 | | |
| ADI-55760 | N/A | N/A |
| ADI-55761 | N/A | N/A |
| ADI-55762 | N/A | N/A |
| ADI-55763 | N/A | N/A |

| ADI ID | ACE-2 competitor? | CR3022 competitor? |
|---|---|---|
| ADI-55765 | N/A | N/A |
| ADI-55766 | N/A | N/A |
| ADI-55767 | N/A | N/A |
| ADI-55769 | N/A | N/A |
| ADI-55770 | N/A | N/A |
| ADI-55771 | N.B. | No |
| ADI-55775 | N/A | N/A |
| ADI-55776 | N/A | N/A |
| ADI-55777 | N/A | N/A |
| ADI-55950 | N/A | N/A |
| ADI-55951 | Yes | Yes |
| ADI-55952 | N/A | N/A |
| ADI-55953 | N/A | N/A |
| ADI-55954 | N/A | N/A |
| ADI-55955 | N/A | N/A |
| ADI-55956 | N/A | N/A |
| ADI-55957 | N/A | N/A |
| ADI-55958 | No | No |
| ADI-55959 | N/A | N/A |
| ADI-55960 | N/A | N/A |
| ADI-55961 | N/A | N/A |
| ADI-55962 | N/A | N/A |
| ADI-55963 | N/A | N/A |
| ADI-55964 | N/A | N/A |
| ADI-55965 | N/A | N/A |

FIG. 21B

| ADI ID | ACE-2 competitor? | CR3022 competitor? |
|---|---|---|
| ADI-55966 | N/A | N/A |
| ADI-55967 | N/A | N/A |
| ADI-55968 | N/A | N/A |
| ADI-55969 | N/A | N/A |
| ADI-55970 | N/A | N/A |
| ADI-55972 | N/A | N/A |
| ADI-55973 | N/A | N/A |
| ADI-55974 | N/A | N/A |
| ADI-55975 | N/A | N/A |
| ADI-55976 | N/A | N/A |
| ADI-55977 | No | No |
| ADI-55978 | N/A | N/A |
| ADI-55979 | N/A | N/A |
| ADI-55980 | N/A | N/A |
| ADI-55981 | N/A | N/A |
| ADI-55982 | N/A | N/A |
| ADI-55984 | N/A | N/A |
| ADI-55986 | N/A | N/A |
| ADI-55988 | N/A | N/A |
| ADI-55989 | N/A | N/A |
| ADI-55990 | N/A | N/A |
| ADI-55992 | N/A | N/A |
| ADI-55993 | Yes | No |
| ADI-55994 | N/A | N/A |
| ADI-55995 | N/A | N/A |
| ADI-55996 | N/A | N/A |
| ADI-55997 | N/A | N/A |
| ADI-55998 | N/A | N/A |
| ADI-55999 | N/A | N/A |
| ADI-56000 | Yes | No |
| ADI-56001 | N/A | N/A |
| ADI-56002 | N/A | N/A |
| ADI-56003 | N/A | N/A |
| ADI-56004 | N/A | N/A |
| ADI-56005 | N/A | N/A |
| ADI-56006 | N/A | N/A |
| ADI-56007 | No | No |
| ADI-56008 | N/A | N/A |
| ADI-56009 | N/A | N/A |
| ADI-56010 | Yes | Yes |
| ADI-56011 | N/A | N/A |
| ADI-56012 | N/A | N/A |
| ADI-56013 | N/A | N/A |
| ADI-56014 | N/A | N/A |
| ADI-56015 | N/A | N/A |
| ADI-56016 | N/A | N/A |
| ADI-56017 | N/A | N/A |
| ADI-56018 | N/A | N/A |
| ADI-56019 | N/A | N/A |
| ADI-56020 | No | Yes |

FIG. 21C

| ADI ID | ACE-2 competitor? | CR3022 competitor? |
|---|---|---|
| ADI-56021 | N/A | N/A |
| ADI-56022 | N/A | N/A |
| ADI-56023 | N/A | N/A |
| ADI-56024 | N/A | N/A |
| ADI-56025 | N/A | N/A |
| ADI-56026 | N/A | N/A |
| ADI-56027 | N/A | N/A |
| ADI-56028 | N/A | N/A |
| ADI-56029 | N/A | N/A |
| ADI-56030 | N/A | N/A |
| ADI-56031 | N/A | N/A |
| ADI-56032 | N/A | N/A |
| ADI-56033 | N/A | N/A |
| ADI-56034 | N/A | N/A |
| ADI-56035 | Yes | No |
| ADI-56037 | N/A | N/A |
| ADI-56038 | N/A | N/A |
| ADI-56039 | N/A | N/A |
| ADI-56040 | No | No |
| ADI-56041 | N/A | N/A |
| ADI-56042 | N/A | N/A |
| ADI-56043 | N/A | N/A |
| ADI-56044 | N/A | N/A |
| ADI-56045 | N/A | N/A |
| ADI-56046 | Yes | Yes |
| ADI-56047 | N/A | N/A |
| ADI-56048 | N/A | N/A |
| ADI-56049 | N/A | N/A |
| ADI-56050 | N/A | N/A |
| ADI-56051 | No | No |
| ADI-56052 | N/A | N/A |
| ADI-56053 | No | No |
| ADI-56054 | N/A | N/A |
| ADI-56055 | N/A | N/A |
| ADI-56056 | N/A | N/A |
| ADI-56057 | N/A | N/A |
| ADI-56058 | No | No |
| ADI-56059 | N/A | N/A |
| ADI-56061 | N/A | N/A |
| ADI-56062 | N/A | N/A |
| ADI-56063 | N/A | N/A |
| ADI-56064 | N/A | N/A |
| ADI-56065 | N/A | N/A |
| ADI-56066 | N/A | N/A |
| ADI-56067 | N/A | N/A |
| ADI-56068 | N/A | N/A |
| ADI-56069 | N/A | N/A |
| ADI-56070 | N/A | N/A |
| ADI-56071 | Yes | No |
| ADI-56072 | N/A | N/A |

FIG. 21D

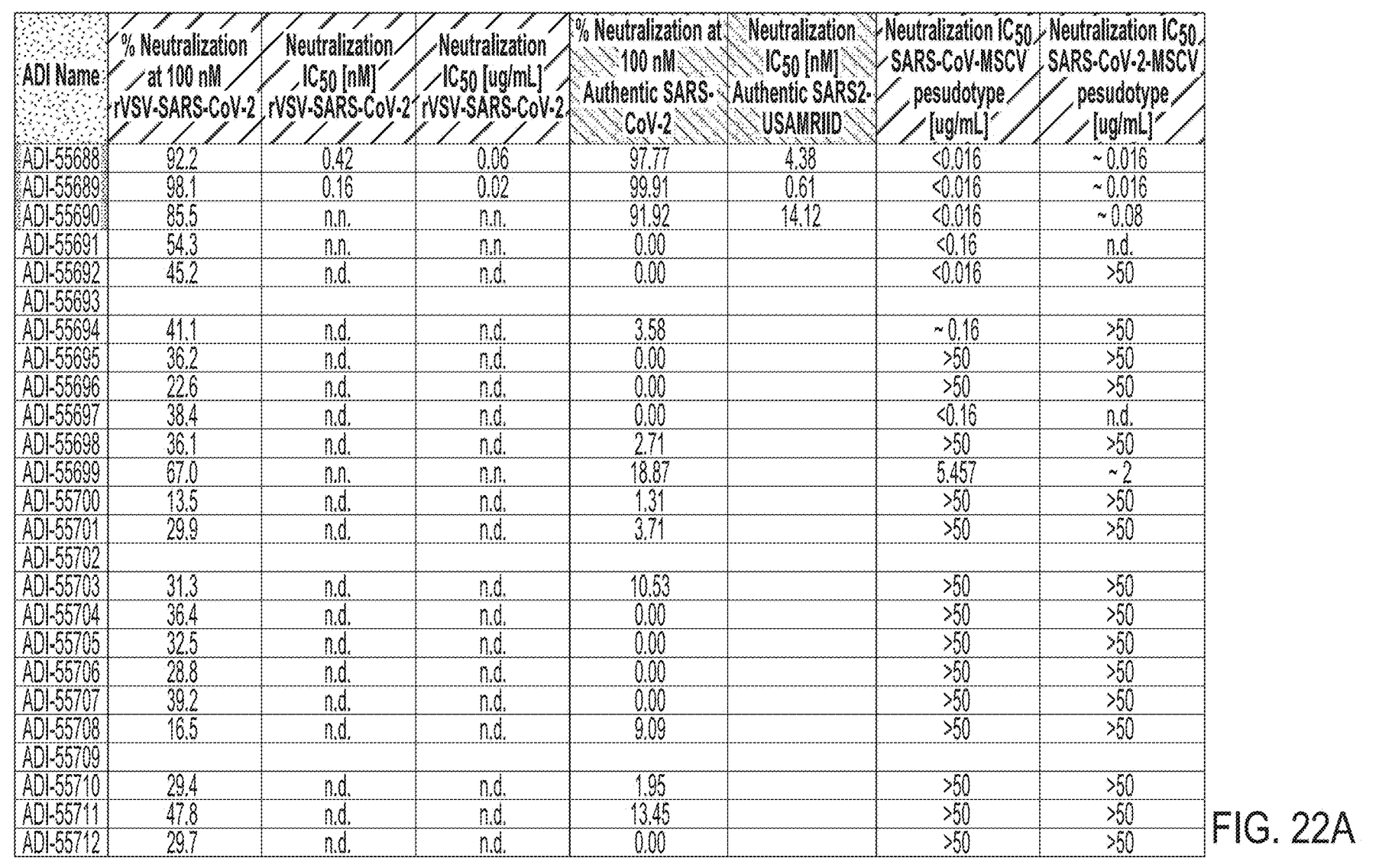

| ADI Name | % Neutralization at 100 nM rVSV-SARS-CoV-2 | Neutralization IC50 [nM] rVSV-S

FIG. 22B

| ADI Name | % Neutralization at 100 nM rVSV-SARS-CoV-2 | Neutralization IC50 [nM] rVSV-SARS-CoV-

| ADI Name | % Neutralization at 100 nM rVSV-SARS-CoV-2 | Neutralization IC50 [nM] rVSV-SARS-CoV-2/rVSV-S

FIG. 22D

| ADI Name | % Neutralization at 100 nM rVSV-SARS-CoV-2 | Neutralization IC50 [nM] rVSV-SARS-CoV-2 | Neutralization IC50 [ug/mL] rVSV-SARS-CoV-2 | % Neutralization at 100 nM Authentic SARS-CoV-2 | Neutralization IC50 [nM] Authentic SARS2-USAMRIID | Neutralization IC50 SARS-CoV-MSCV pseudotype [ug/mL] | Neutralization IC50 SARS-CoV-2-MSCV pseudotype [ug/mL] |
|---|---|---|---|---|---|---|---|
| ADI-55765 | n.d. | n.d. | n.d. | n.d. | | n.d. | n.d. |
| ADI-55766 | n.d. | n.d. | n.d. | n.d. | | n.d. | n.d. |
| ADI-55767 | n.d. | n.d. | n.d. | n.d. | | n.d. | n.d. |
| ADI-55769 | n.d. | n.d. | n.d. | n.d. | | n.d. | n.d. |
| ADI-55770 | n.d. | n.d. | n.d. | n.d. | | n.d. | n.d. |
| ADI-55771 | n.d. | n.d. | n.d. | n.d. | | n.d. | n.d. |
| ADI-55775 | n.d. | n.d. | n.d. | n.d. | | n.d. | n.d. |
| ADI-55776 | n.d. | n.d. | n.d. | n.d. | | n.d. | n.d. |
| ADI-55777 | n.d. | n.d. | n.d. | n.d. | | n.d. | n.d. |
| ADI-55950 | 44.4 | n.d. | n.d. | 0.00 | | n.d. | n.d. |
| ADI-55951 | 89.8 | 0.57 | 0.08 | 62.42 | 19.41 | n.d. | n.d. |
| ADI-55952 | 24.5 | n.d. | n.d. | 0.00 | | n.d. | n.d. |
| ADI-55953 | 27.3 | n.d. | n.d. | 0.65 | | n.d. | n.d. |
| ADI-55954 | 25.3 | n.d. | n.d. | 4.73 | | n.d. | n.d. |
| ADI-55955 | 39.2 | n.d. | n.d. | 6.28 | | n.d. | n.d. |
| ADI-55956 | 2.1 | n.d. | n.d. | n.d. | | n.d. | n.d. |
| ADI-55957 | 22.3 | n.d. | n.d. | 3.47 | | n.d. | n.d. |
| ADI-55958 | 34.0 | n.d. | n.d. | 4.37 | | n.d. | n.d. |
| ADI-55959 | 32.9 | n.d. | n.d. | 0.00 | | n.d. | n.d. |
| ADI-55960 | 34.5 | n.d. | n.d. | 8.53 | | n.d. | n.d. |
| ADI-55961 | 31.2 | n.d. | n.d. | 0.00 | | n.d. | n.d. |
| ADI-55962 | 24.4 | n.d. | n.d. | 0.24 | | n.d. | n.d. |
| ADI-55963 | 28.4 | n.d. | n.d. | 6.96 | | n.d. | n.d. |
| ADI-55964 | 19.7 | n.d. | n.d. | 0.00 | | n.d. | n.d. |
| ADI-55965 | 26.2 | n.d. | n.d. | 0.00 | | n.d. | n.d. |

| ADI Name | % Neutralization at 100 nM rVSV-SARS-CoV-2 | Neutralization $IC_{50}$ [nM] rVSV-SARS-CoV-2 | Neutralization $IC_{50}$ [ug/mL] rVSV-SARS-CoV-2 | % Neutralization at 100 nM Authentic SARS-CoV-2 | Neutralization $IC_{50}$ [nM] Authentic SARS2-USAMRIID | Neutralization $IC_{50}$ SARS-CoV-MSCV pesudotype [ug/mL] | Neutralization $IC_{50}$ SARS-CoV-2-MSCV pesudotype [ug/mL] |
|---|---|---|---|---|---|---|---|
| ADI-55966 | 45.3 | n.d. | n.d. | 2.66 | | n.d. | n.d. |
| ADI-55967 | 27.1 | n.d. | n.d. | 3.79 | | n.d. | n.d. |
| ADI-55968 | 21.0 | n.d. | n.d. | 0.26 | | n.d. | n.d. |
| ADI-55969 | 32.2 | n.d. | n.d. | 13.64 | | n.d. | n.d. |
| ADI-55970 | 9.0 | n.d. | n.d. | 7.21 | | n.d. | n.d. |
| ADI-55972 | 23.6 | n.d. | n.d. | 11.87 | | n.d. | n.d. |
| ADI-55973 | 27.2 | n.d. | n.d. | 0.00 | | n.d. | n.d. |
| ADI-55974 | 34.7 | n.d. | n.d. | 0.00 | | n.d. | n.d. |
| ADI-55975 | 12.0 | n.d. | n.d. | n.d. | | n.d. | n.d. |
| ADI-55976 | 21.8 | n.d. | n.d. | 1.29 | | n.d. | n.d. |
| ADI-55977 | 15.8 | n.d. | n.d. | 0.00 | | n.d. | n.d. |
| ADI-55978 | 32.8 | n.d. | n.d. | 11.84 | | n.d. | n.d. |
| ADI-55979 | 30.8 | n.d. | n.d. | 0.00 | | n.d. | n.d. |
| ADI-55980 | 33.2 | n.d. | n.d. | 0.00 | | n.d. | n.d. |
| ADI-55981 | 24.8 | n.d. | n.d. | 0.00 | | n.d. | n.d. |
| ADI-55982 | 26.5 | n.d. | n.d. | 0.00 | | n.d. | n.d. |
| ADI-55984 | 49.8 | n.d. | n.d. | 0.00 | | n.d. | n.d. |
| ADI-55986 | 9.6 | n.d. | n.d. | 0.00 | | n.d. | n.d. |
| ADI-55988 | 46.3 | n.d. | n.d. | 0.75 | | n.d. | n.d. |
| ADI-55989 | 36.6 | n.d. | n.d. | 4.03 | | n.d. | n.d. |
| ADI-55990 | 41.9 | n.d. | n.d. | 0.00 | | n.d. | n.d. |
| ADI-55992 | 45.1 | n.d. | n.d. | 9.26 | | n.d. | n.d. |
| ADI-55993 | 95.6 | 0.25 | 0.04 | 99.28 | 0.82 | n.d. | n.d. |
| ADI-55994 | 27.0 | n.d. | n.d. | 14.11 | | n.d. | n.d. |
| ADI-55995 | 26.1 | n.d. | n.d. | 0.00 | | n.d. | n.d. |

FIG. 22E

| ADI Name | % Neutralization at 100 nM rVSV-SARS-CoV-2 | Neutralization $IC_{50}$ [nM] rVSV-SARS-CoV-2 | Neutralization $IC_{50}$ [ug/mL] rVSV-SARS-CoV-2 | % Neutralization at 100 nM Authentic SARS-CoV-2 | Neutralization $IC_{50}$ [nM] Authentic SARS2-USAMRIID | Neutralization $IC_{50}$ SARS-CoV-MSCV pesudotype [ug/mL] | Neutralization $IC_{50}$ SARS-CoV-2-MSCV pesudotype [ug/mL] |
|---|---|---|---|---|---|---|---|
| ADI-55996 | 66.4 | n.d. | n.d. | 0.00 | | n.d. | n.d. |
| ADI-55997 | 19.8 | n.d. | n.d. | 6.87 | | n.d. | n.d. |
| ADI-55998 | 12.3 | n.d. | n.d. | n.d. | | n.d. | n.d. |
| ADI-55999 | 18.3 | n.d. | n.d. | 0.00 | | n.d. | n.d. |
| ADI-56000 | 95.6 | 0.82 | 0.12 | 98.18 | 1.28 | n.d. | n.d. |
| ADI-56001 | 21.7 | n.d. | n.d. | 16.60 | | n.d. | n.d. |
| ADI-56002 | 17.1 | n.d. | n.d. | 1.93 | | n.d. | n.d. |
| ADI-56003 | 46.5 | n.d. | n.d. | 4.57 | | n.d. | n.d. |
| ADI-56004 | 38.0 | n.d. | n.d. | 0.00 | | n.d. | n.d. |
| ADI-56005 | 29.9 | n.d. | n.d. | 20.81 | | n.d. | n.d. |
| ADI-56006 | 33.9 | n.d. | n.d. | 7.18 | | n.d. | n.d. |
| ADI-56007 | 49.3 | n.d. | n.d. | 0.84 | | n.d. | n.d. |
| ADI-56008 | 30.5 | n.d. | n.d. | 6.74 | | n.d. | n.d. |
| ADI-56009 | 26.4 | n.d. | n.d. | 0.00 | | n.d. | n.d. |
| ADI-56010 | 91.5 | 0.42 | 0.06 | 99.39 | 4.26 | n.d. | n.d. |
| ADI-56011 | 37.7 | n.d. | n.d. | 10.91 | | n.d. | n.d. |
| ADI-56012 | 27.1 | n.d. | n.d. | 0.18 | | n.d. | n.d. |
| ADI-56013 | 50.8 | n.d. | n.d. | 0.00 | | n.d. | n.d. |
| ADI-56014 | 12.3 | n.d. | n.d. | 3.05 | | n.d. | n.d. |
| ADI-56015 | 65.4 | n.d. | n.d. | 0.00 | | n.d. | n.d. |
| ADI-56016 | 12.2 | n.d. | n.d. | 1.30 | | n.d. | n.d. |
| ADI-56017 | 24.7 | n.d. | n.d. | 0.00 | | n.d. | n.d. |
| ADI-56018 | 16.7 | n.d. | n.d. | 5.05 | | n.d. | n.d. |
| ADI-56019 | 25.0 | n.d. | n.d. | 0.00 | | n.d. | n.d. |
| ADI-56020 | 70.6 | n.d. | n.d. | 6.60 | | n.d. | n.d. |

FIG. 22F

| ADI Name | % Neutralization at 100 nM rVSV-SARS-CoV-2 | Neutralization IC50 [nM] rVSV-SARS-CoV-2 | Neutralization

| ADI Name | % Neutralization at 100 nM rVSV-SARS-CoV-2 | Neutralization $IC_{50}$ [nM] rVSV-SARS-CoV-2 | Neutralization $IC_{50}$ [ug/mL] rVSV-SARS-CoV-2 | % Neutralization at 100 nM Authentic SARS-CoV-2 | Neutralization $IC_{50}$ [nM] Authentic SARS2-USAMRIID | Neutralization $IC_{50}$ SARS-CoV-MSCV pesudotype [ug/mL] | Neutralization $IC_{50}$ SARS-CoV-2-MSCV pesudotype [ug/mL] |
|---|---|---|---|---|---|---|---|
| ADI-56047 | 24.0 | n.d. | n.d. | 16.25 | | n.d. | n.d. |
| ADI-56048 | 27.7 | n.d. | n.d. | 13.76 | | n.d. | n.d. |
| ADI-56049 | 20.9 | n.d. | n.d. | 0.00 | | n.d. | n.d. |
| ADI-56050 | 9.2 | n.d. | n.d. | 4.03 | | n.d. | n.d. |
| ADI-56051 | 29.3 | n.d. | n.d. | 0.00 | | n.d. | n.d. |
| ADI-56052 | 26.3 | n.d. | n.d. | 0.00 | | n.d. | n.d. |
| ADI-56053 | 26.8 | n.d. | n.d. | 0.00 | | n.d. | n.d. |
| ADI-56054 | 15.1 | n.d. | n.d. | 7.08 | | n.d. | n.d. |
| ADI-56055 | 35.7 | n.d. | n.d. | 0.00 | | n.d. | n.d. |
| ADI-56056 | 21.5 | n.d. | n.d. | 0.96 | | n.d. | n.d. |
| ADI-56057 | 39.2 | n.d. | n.d. | 0.00 | | n.d. | n.d. |
| ADI-56058 | 44.5 | n.d. | n.d. | 0.00 | | n.d. | n.d. |
| ADI-56059 | 29.7 | n.d. | n.d. | 8.14 | | n.d. | n.d. |
| ADI-56061 | 35.8 | n.d. | n.d. | 0.04 | | n.d. | n.d. |
| ADI-56062 | 5.1 | n.d. | n.d. | 5.39 | | n.d. | n.d. |
| ADI-56063 | 56.2 | n.d. | n.d. | 9.86 | | n.d. | n.d. |
| ADI-56064 | 21.0 | n.d. | n.d. | 0.00 | | n.d. | n.d. |
| ADI-56065 | 7.7 | n.d. | n.d. | 4.03 | | n.d. | n.d. |
| ADI-56066 | 16.4 | n.d. | n.d. | n.d. | | n.d. | n.d. |
| ADI-56067 | 30.5 | n.d. | n.d. | 2.90 | | n.d. | n.d. |
| ADI-56068 | 22.8 | n.d. | n.d. | 2.12 | | n.d. | n.d. |
| ADI-56069 | 23.7 | n.d. | n.d. | 4.03 | | n.d. | n.d. |
| ADI-56070 | 17.5 | n.d. | n.d. | 6.12 | | n.d. | n.d. |
| ADI-56071 | 57.2 | n.d. | n.d. | 11.47 | | n.d. | n.d. |
| ADI-56072 | 29.8 | n.d. | n.d. | 0.00 | | n.d. | n.d. |

FIG. 22H

| ADI Name | % Neutralization at 100 nM rVSV-SARS-CoV-2 | Neutralization $IC_{50}$ [nM] rVSV-SARS-CoV-2 | Neutralization $IC_{50}$ [ug/mL] rVSV-SARS-CoV-2 | % Neutralization at 100 nM Authentic SARS-CoV-2 | Neutralization $IC_{50}$ [nM] Authentic SARS2-USAMRIID | Neutralization $IC_{50}$ SARS-CoV-MSCV pesudotype [ug/mL] | Neutralization $IC_{50}$ SARS-CoV-2-MSCV pesudotype [ug/mL] |
|---|---|---|---|---|---|---|---|
| ADI-56073 | 23.8 | n.d. | n.d. | n.d. | | n.d. | n.d. |
| ADI-56074 | 13.0 | n.d. | n.d. | n.d. | | n.d. | n.d. |
| ADI-56075 | 24.3 | n.d. | n.d. | 0.00 | | n.d. | n.d. |
| ADI-56076 | 19.0 | n.d. | n.d. | 3.48 | | n.d. | n.d. |
| ADI-56078 | 11.6 | n.d. | n.d. | n.d. | | n.d. | n.d. |
| ADI-56079 | 20.1 | n.d. | n.d. | 0.00 | | n.d. | n.d. |
| ADI-56080 | 15.1 | n.d. | n.d. | 2.01 | | n.d. | n.d. |
| ADI-56081 | 24.8 | n.d. | n.d. | 5.84 | | n.d. | n.d. |
| ADI-56082 | n.d. | n.d. | n.d. | n.d. | | n.d. | n.d. |
| ADI-56083 | n.d. | n.d. | n.d. | n.d. | | n.d. | n.d. |
| ADI-56084 | n.d. | n.d. | n.d. | n.d. | | n.d. | n.d. |

| ADI Name | Antigenic Site | SARS-CoV-MLV pesudos [ug/mL] | SARS-CoV-2 MLV pesudos [ug/mL] | Authentic SARS-CoV-2 IC50 (ug/mL) | rVSV-SARS-CoV-2 IC50 [ug/mL] |
|---|---|---|---|---|---|
| ADI-55951 | RBD / hACE2 / CR3022 | ND | ND | 9.71 | 0.08 |
| ADI-55690 | RBD / hACE2 / CR3022 | 0.034 | 1.24 | 7.06 | 50.00 |
| ADI-56032 | NTD | ND | ND | 2.58 | ND |
| ADI-55688 | RBD / hACE2 | 0.004 | 0.56 | 2.19 | 0.06 |
| ADI-56010 | RBD / hACE2 / CR3022 | ND | ND | 2.13 | 0.06 |
| ADI-56046 | RBD / hACE2 / CR3022 | 0.090 | 0.16 | 0.65 | 0.01 |
| ADI-56000 | RBD / hACE2 | >50 | ND | 0.64 | 0.12 |
| ADI-55993 | RBD / hACE2 | ND | ND | 0.41 | 0.04 |
| ADI-55689 | RBD / hACE2 | 0.009 | 0.23 | 0.31 | 0.02 |

| ADI ID | VH_CDR3 | Sequence_Reduced | ClusterId |
|---|---|---|---|
| ADI-55702 | ARDPSIHYTGNHHWYDLDI | ARDPAINFAGNNNFFDIDI | 1 |
| ADI-55704 | ARDPSIHYTGNHHWYDLDI | ARDPAINFAGNNNFFDIDI | 1 |
| ADI-55706 | ARDPSIHYTGNHHWYDLDI | ARDPAINFAGNNNFFDIDI | 1 |
| ADI-55723 | ARDPSILNTGNHHWYDLDI | ARDPAIINAGNNNFFDIDI | 1 |
| ADI-55725 | ARDPTFLNSGNHFWYAVDI | ARDPAFINAGNNFFFAIDI | 1 |
| ADI-55726 | ARDPTFLNTGNHFWYAVDI | ARDPAFINAGNNFFFAIDI | 1 |
| ADI-55728 | ARDPSILNTGNHHWYDLDL | ARDPAIINAGNNNFFDIDI | 1 |
| ADI-55731 | ARDPSFLNTGNHFWYDFDM | ARDPAFINAGNNFFFDFDI | 1 |
| ADI-55739 | ARDPSILNTGNHHWYDLDM | ARDPAIINAGNNNFFDIDI | 1 |
| ADI-55741 | ARDPSILNTGNHHWYDLDL | ARDPAIINAGNNNFFDIDI | 1 |
| ADI-55743 | ARDPSILNTGNHHWYDLDM | ARDPAIINAGNNNFFDIDI | 1 |
| ADI-55745 | ARDPSILNTGNHHWYDLDM | ARDPAIINAGNNNFFDIDI | 1 |
| ADI-55748 | ARDPSILNTGNHHWYDLDM | ARDPAIINAGNNNFFDIDI | 1 |
| ADI-55700 | VRDSDPYTATVTSNHYWYAMDV | IRDADPFAAAIAANNFFFAIDI | 2 |
| ADI-55705 | VRDSDPYTATYRNNHYWYAMDV | IRDADPFAAAFRNNNFFFAIDI | 2 |
| ADI-55712 | VRDSDPYTATVRNNHYWYALDV | IRDADPFAAAIRNNNFFFAIDI | 2 |
| ADI-55717 | VRDSDPYTTTFSNHYWYAMDV | IRDADPFAAAFANNNFFFAIDI | 2 |
| ADI-55736 | VRDSDPYTTTFSNHYWYAMDV | IRDADPFAAAFANNNFFFAIDI | 2 |
| ADI-55742 | VRDSDPYTATSRNNHYWYGMDV | IRDADPFAAAARNNNFFFGIDI | 2 |
| ADI-55747 | VRDSDPYTATSRNNHYWYGMDV | IRDADPFAAAARNNNFFFGIDI | 2 |
| ADI-55695 | ARATPPGGTTGWPYIDL | ARAAPPGGAAGFPFIDI | 3 |
| ADI-55698 | VRASPPGGNTGWPFFED | IRAAPPGGNAGFPFFDD | 3 |
| ADI-55714 | ARATPPGGGTGWPYFDF | ARAAPPGGGAGFPFFDF | 3 |
| ADI-55688 | ARDFSGHTAVAGTGFEY | ARDFAGNAAIAGAGFDF | 4 |
| ADI-55691 | ARDFPGDTAVAGTGFNY | ARDFPGDAAIAGAGFNF | 4 |
| ADI-55693 | ARDFPGDTAVAGTGFNY | ARDFPGDAAIAGAGFNF | 4 |
| ADI-55708 | ARGSLSREYDFLTAPQNGPWFDS | ARGAIARDFDFIAAPNNGPFFDA | 5 |
| ADI-55709 | ARGSLSREYDFLTAPQNGPWFDS | ARGAIARDFDFIAAPNNGPFFDA | 5 |
| ADI-55719 | ARGSLSREYDFLTAPQNGPWFDS | ARGAIARDFDFIAAPNNGPFFDA | 5 |

FIG. 27A

| ADI ID | VH. CDR3 | Sequence_Reduced | ClusterId |
|---|---|---|---|
| ADI-55696 | ASEYFDGRSYHSFCGLDV | AADFFDGRAFNAFIGIDI | 6 |
| ADI-55744 | ASEYFDGRSYHSFCGLDV | AADFFDGRAFNAFIGIDI | 6 |
| ADI-55701 | AREEYSGTVHNFFGMDV | ARDDFAGAINNFFGIDI | 7 |
| ADI-55715 | AREEPSGTYHNYYGLDV | ARDDPAGAFNNFFGIDI | 7 |
| ADI-55738 | ARDNVVQQNADNVGYFDF | ARDNIINNNADNIGFFDF | 8 |
| ADI-55740 | ARDNVVQQNADNVGYFDF | ARDNIINNNADNIGFFDF | 8 |
| ADI-55711 | AKCDLVRYFDWLGEENNWFDP | ARIDIIRFFDFIGDDNNFFDP | 9 |
| ADI-55720 | AKCDLVRYFDWLGEENNWFDP | ARIDIIRFFDFIGDDNNFFDP | 9 |
| ADI-55710 | ARVGWVRYFDWSKPYYYFDL | ARIGFIRFFDFARPFFFFDI | 10 |
| ADI-55713 | ARVGWVRYFDWSKPYYYFDL | ARIGFIRFFDFARPFFFFDI | 10 |
| ADI-55722 | ARMGPYGSGSFDY | ARIGPFGAGAFDF | 11 |
| ADI-55752 | ARMGPYGSGTFDY | ARIGPFGAGAFDF | 11 |
| ADI-55721 | VLDTTSANPHNWYGMDV | IIDAAAANPNNFFGIDI | 12 |
| ADI-55729 | VVDTTMADPHNWYGLDV | IIDAAIADPNNFFGIDI | 12 |
| ADI-55724 | VRDGAYDSSGYYSTQ | IRDGAFDAAGFFAAN | 13 |
| ADI-55732 | VRDGAYDSSGYYSTQ | IRDGAFDAAGFFAAN | 13 |
| ADI-55716 | AARIRGATHYDFWSGFWAGPFDI | AARIRGAANFDFFAGFFAGPFDI | 14 |
| ADI-55690 | AGRHQELLPMGSFDM | AGRNNDIIPIGAFDI | 15 |
| ADI-55757 | AHTSELPPRRPYAAFDF | ANAADIPPRRPFAAFDF | 16 |
| ADI-55758 | ANTNFLDY | ANANFIDF | 17 |
| ADI-55718 | ARTQSNDFWSGYYTAAFDL | ARANANDFFAGFFAAAAFDI | 18 |
| ADI-55703 | ARAKGGSYSNAFDY | ARARGGAFANAFDF | 19 |
| ADI-55727 | ARDFGVRYDDSRQLMKYCDS | ARDFGIRFDDARNIIRFIDA | 20 |

FIG. 27B

| ADI ID | VH.CDR3 | Sequence_Reduced | ClusterId |
|---|---|---|---|
| ADI-55692 | AREGTSLGYYYYYAMDV | ARDGAAIGFFFFFAIDI | 21 |
| ADI-55735 | ARDLPPLDY | ARDIPPIDF | 22 |
| ADI-55733 | SRDLRRGYYDSNGHQQFDL | ARDIRRGFFDANGNNNFDI | 23 |
| ADI-55753 | ARDHALQNGRPGYFDS | ARDNAINNGRPGFFDA | 24 |
| ADI-55734 | ARDPGPITFFDWSPDKSRKSYYDYNGMDV | ARDPGPIAFFDFAPDRARRAFFDFNGIDI | 25 |
| ADI-55750 | AKERDLPGRGGYFDH | ARDRDIPGRGGFFDN | 26 |
| ADI-55694 | AREKKSFGPQYYYGSGED | ARDRRAFGPNFFFGAGDD | 27 |
| ADI-55751 | ARGYTAPIIREVPITFRPRWFDP | ARGFAAPIIRDIPIAFRPRFFDP | 28 |
| ADI-55707 | ARGQESPIVGVTGRWFDP | ARGNDAPIIGIAGRFFDP | 29 |
| ADI-55746 | ARGPIRHFGLDAFDI | ARGPIRNFGIDAFDI | 30 |
| ADI-55730 | ARVRVGASHHNFWSGYYTDAFDI | ARIRIGAANNNFFAGFFADAFDI | 31 |
| ADI-55699 | AKKGSPYCGVDCYKGYFDY | ARRGAPFIGIDIFRGFFDF | 32 |
| ADI-55697 | ARRGNNFGYYYYYTVDV | ARRGNNFGFFFFFAIDI | 33 |
| ADI-55756 | VRDTDWAFDS | IRDADFAFDA | 34 |
| ADI-55689 | VKDGGYYDSSGPGH | IRDGGFFDAAGPGN | 35 |
| ADI-55754 | VREGQQWLGLYFDH | IRDGNNFIGIFFDN | 36 |
| ADI-55749 | VKDLGATVTYDVFDV | IRDIGAAIAFDIFDI | 37 |
| ADI-55737 | VKDNVILPGAIVRPQFDY | IRDNIIPGAIRPNFDF | 38 |
| ADI-55755 | VRQRYCSGGSCFLFEDAFEI | IRNRFIAGGAIFIFDDAFDI | 39 |

FIG. 27C

Cluster 1:

| A | R | D | P | S | I | H | Y | T | G | N | H | H | W | Y | D | L | D | I |
|---|---|---|---|---|---|---|---|---|---|---|---|---|---|---|---|---|---|---|
| A | R | D | P | S | I | H | Y | T | G | N | H | H | W | Y | D | L | D | I |
| A | R | D | P | S | I | H | Y | T | G | N | H | H | W | Y | D | L | D | I |
| A | R | D | P | S | I | L | N | T | G | N | H | H | W | Y | D | L | D | I |
| A | R | D | P | T | F | L | N | S | G | N | H | F | W | Y | A | V | D | I |
| A | R | D | P | T | F | L | N | T | G | N | H | F | W | Y | A | V | D | I |
| A | R | D | P | S | I | L | N | T | G | N | H | H | W | Y | D | L | D | L |
| A | R | D | P | S | F | L | N | T | G | N | H | F | W | Y | D | F | D | M |
| A | R | D | P | S | I | L | N | T | G | N | H | H | W | Y | D | L | D | M |
| A | R | D | P | S | I | L | N | T | G | N | H | H | W | Y | D | L | D | L |
| A | R | D | P | S | I | L | N | T | G | N | H | H | W | Y | D | L | D | M |
| A | R | D | P | S | I | L | N | T | G | N | H | H | W | Y | D | L | D | M |
| A | R | D | P | S | I | L | N | T | G | N | H | H | W | Y | D | L | D | M |

Cluster 2:

| V | R | D | S | D | P | Y | T | A | T | V | T | S | N | H | Y | W | Y | A | M | D | V |
|---|---|---|---|---|---|---|---|---|---|---|---|---|---|---|---|---|---|---|---|---|---|
| V | R | D | S | D | P | Y | T | A | T | Y | R | N | N | H | Y | W | Y | A | M | D | V |
| V | R | D | S | D | P | Y | T | A | T | V | R | N | N | H | Y | W | Y | A | L | D | V |
| V | R | D | S | D | P | Y | T | T | T | F | S | H | N | H | Y | W | Y | A | M | D | V |
| V | R | D | S | D | P | Y | T | T | T | F | S | H | N | H | Y | W | Y | A | M | D | V |
| V | R | D | S | D | P | Y | T | A | T | S | R | N | N | H | Y | W | Y | A | M | D | V |
| V | R | D | S | D | P | Y | T | A | T | S | R | N | N | H | Y | W | Y | A | M | D | V |

| ADI ID | Donor | B cell phenotype | Epitope | Lineage (ADI name before affinity maturation, if applicable) | Authentic SARS-CoV-2 neuturalization IC50 (ug/ml) | Authentic SARS-CoV neuturalization IC50 (ug/ml) | Pseudo SARS-CoV-2 MLV neutralization IC50 (ug/ml) | Pseudo SARS-CoV MLV neutralization IC50 (ug/ml) |
|---|---|---|---|---|---|---|---|---|
| ADI-57983 (with primer mutation) | SARS-CoV (17 years post infection) | IgG+ | RBD; ACE2 competitor | ADI-55689 | 0.007 | 0.0025 | 0.007 | 0.0025 |
| ADI-57978 (with primer mutation) | SARS-CoV (17 years post infection) | IgG+ | RBD; ACE2 competitor | ADI-55688 | 0.020 | 0.0020 | 0.020 | 0.0020 |
| ADI-56868 (with primer mutation) | SARS-CoV (17 years post infection) | IgG+ | RBD; ACE2 competitor | ADI-56046 | 0.039 | 0.042 | 0.039 | 0.042 |
| ADI-56443 (with primer mutation) | SARS-CoV2 (23 days post diagnosis) | IgG+ CD71- CD27+ | RBD; ACE2 competitor (non-competing with ADI-57983, ADI-57978, or ADI-56868) | N/A | 0.034 | Unlikely | N/A | Unlikely |
| ADI-56479 (with primer mutation) | SARS-CoV2 (26 days post diagnosis) | IgG+ CD71+ CD27- | NTD | N/A | 0.07 | Unlikely | N/A | Unlikely |

FIG. 31A

| ADID | Fab pI | Parent Fab (Pre-affinity maturation) pI | PSR | HIC | Tm |
|---|---|---|---|---|---|
| ADI-57983 (with primer mutation) | 9.4 | 9.3 | 0 | 9.61 | 64.5 |
| ADI-57978 (with primer mutation) | 8.5 | 8.8 | 0 | 10.125 | 67 |
| ADI-56868 (with primer mutation) | 9.1 | 8.9 | 0 | 8.825 | 67.5 |
| ADI-56443 (with primer mutation) | 8.9 | na | 0 | 9.917 | 69.5 |
| ADI-56479 (with primer mutation) | 8.3 | na | 0.05 | 14.319 | in progress |

FIG. 31B

| ADI ID | SARS-CoV-2 S binder? | SARS-CoV-2 RBD binder? | SARS-CoV-2 NTD binder? | Competes with hACE2? | Competes with CR3022? |
|---|---|---|---|---|---|
| ADI-56443 (with primer mutation) | x | Yes | | Yes | No |
| ADI-56479 (with primer mutation) | x | | Yes | N/A | N/A |

| ADI ID | %rVSV-SARS-CoV-2 neutralization at 25nM | rVSV-SARS-CoV-2 neutralization IC50 (nM) | %Authentic SARS-CoV-2 neutralization at 100nM | Authentic SARS-CoV-2 neutralization IC50 (nM) | Authentic SARS-CoV-2 neutralization IC50 (ug/mL) | Authentic/rVSV (IC50 (nM) fold difference) |
|---|---|---|---|---|---|---|
| ADI-56443 (with primer mutation) | 99.65 | 0.02 | 99.88 | 0.22 | 0.03 | 11.34 |
| ADI-56479 (with primer mutation) | 81.24 | 4.66 | 99.31 | 0.47 | 0.07 | 0.10 |

FIG. 33

| ADI ID | ADI ID before fixing primer mutation(s) | Reversion back to germline-encoded sequence |
|---|---|---|
| ADI-58120 | ADI-57983 (with primer mutation) | QV to EV in VH FR1 |
| ADI-58124 | ADI-57978 (with primer mutation) | QP to QS in VL FR1 |
| ADI-58126 | ADI-56868 (with primer mutation) | M to T in VH FR4; QP to QS in VL FR1 |
| ADI-58128 | ADI-56443 (with primer mutation) | EVQLLE to QVQLVQ in VH FR1 |
| ADI-58130 | ADI-56479 (with primer mutation) | L to V in VH FR1 |

FIG. 34

| ADI ID | ADI ID before fixing primer mutation(s) | VH Germline | VH Amino Acid Substitutions relative to germline-encoded | VH Nucleotide Substitutions relative to germline | VL Germline | VL Amino Acid Substitutions relative to germline encoded | VL Nucleotide Substitutions relative to germline |
|---|---|---|---|---|---|---|---|
| ADI-58120 | ADI-57983 (with primer mutation) | IGHV3-64D | 12 | 16 | IGKV3-11 | 10 | 15 |
| ADI-58124 | ADI-57978 (with primer mutation) | IGHV3-21 | 11 | 17 | IGLV1-40 | 4 | 6 |
| ADI-58126 | ADI-56868 (with primer mutation) | IGHV3-53 | 11 | 14 | IGLV1-44 | 3 | 3 |
| ADI-58128 | ADI-56443 (with primer mutation) | IGHV1-69 | 3 | 4 | IGKV1-33 | 0 | 0 |
| ADI-58130 | ADI-56479 (with primer mutation) | IGHV2-9 | 1 | 2 | IGKV2D-28 | 0 | 0 |

FIG. 35

| ADI ID | Variable region same as | Fc Variant Name (if applicable) | HC Protein SEQ ID NO: | VH Protein SEQ ID NO: | VH FR1 Protein SEQ ID NO: | VH CDR1 Protein SEQ ID NO: | VH FR2 Protein SEQ ID NO: | VH CDR2 Protein SEQ ID NO: | VH FR3 Protein SEQ ID NO: | VH CDR3 Protein SEQ ID NO: | VH FR4 Protein SEQ ID NO: | VH DNA SEQ ID NO: |
|---|---|---|---|---|---|---|---|---|---|---|---|---|
| ADI-57983 (with primer mutation) | | | | 21202 | 21203 | 21204 | 21205 | 21206 | 21207 | 21208 | 21209 | 21210 |
| ADI-57978 (with primer mutation) | | | | 21302 | 21303 | 21304 | 21305 | 21306 | 21307 | 21308 | 21309 | 21310 |
| ADI-56868 (with primer mutation) | | | | 21402 | 21403 | 21404 | 21405 | 21406 | 21407 | 21408 | 21409 | 21410 |
| ADI-56443 (with primer mutation) | | | | 21502 | 21503 | 21504 | 21505 | 21506 | 21507 | 21508 | 21509 | 21510 |
| ADI-56479 (with primer mutation) | | | | 21602 | 21603 | 21604 | 21605 | 21606 | 21607 | 21608 | 21609 | 21610 |

FIG. 36A

| | | | | | | | | | | |
|---|---|---|---|---|---|---|---|---|---|---|
| ADI-58120 | ADI-58120 | WT | 21701 | 21702 | 21703 | 21704 | 21705 | 21706 | 21707 | 21708 | 21709 | 21710 |
| ADI-58121 | ADI-58120 | YTE | 21801 | 21802 | 21803 | 21804 | 21805 | 21806 | 21807 | 21808 | 21809 | 21810 |
| ADI-58122 | ADI-58120 | LA | 21901 | 21902 | 21903 | 21904 | 21905 | 21906 | 21907 | 21908 | 21909 | 21910 |
| ADI-58123 | ADI-58120 | LS | 22001 | 22002 | 22003 | 22004 | 22005 | 22006 | 22007 | 22008 | 22009 | 22010 |
| Not assigned | ADI-58120 | LA-RE | 22101 | 22102 | 22103 | 22104 | 22105 | 22106 | 22107 | 22108 | 22109 | 22110 |
| ADI-58124 | ADI-58124 | WT | 22201 | 22202 | 22203 | 22204 | 22205 | 22206 | 22207 | 22208 | 22209 | 22210 |
| ADI-58125 | ADI-58124 | LA | 22301 | 22302 | 22303 | 22304 | 22305 | 22306 | 22307 | 22308 | 22309 | 22310 |
| ADI-58126 | ADI-58126 | WT | 22401 | 22402 | 22403 | 22404 | 22405 | 22406 | 22407 | 22408 | 22409 | 22410 |
| ADI-58127 | ADI-58126 | LA | 22501 | 22502 | 22503 | 22504 | 22505 | 22506 | 22507 | 22508 | 22509 | 22510 |
| ADI-58128 | ADI-58128 | WT | 22601 | 22602 | 22603 | 22604 | 22605 | 22606 | 22607 | 22608 | 22609 | 22610 |
| ADI-58130 | ADI-58130 | WT | 22701 | 22702 | 22703 | 22704 | 22705 | 22706 | 22707 | 22708 | 22709 | 22710 |
| ADI-58129 | ADI-58128 | LA | 22801 | 22802 | 22803 | 22804 | 22805 | 22806 | 22807 | 22808 | 22809 | 22810 |
| ADI-58131 | ADI-58130 | LA | 22901 | 22902 | 22903 | 22904 | 22905 | 22906 | 22907 | 22908 | 22909 | 22910 |
| ADI-58130_LCN30cQ | ADI-58130_LCN30cQ | WT | 23001 | 23002 | 23003 | 23004 | 23005 | 23006 | 23007 | 23008 | 23009 | 23010 |
| ADI-59988 | ADI-58130_LCN30cQ | LA | 23101 | 23102 | 23103 | 23104 | 23105 | 23106 | 23107 | 23108 | 23109 | 23110 |

FIG. 36A CONTINUED

| ADI ID | Variable region same as | Fc Variant Name (if applicable) | LC Protein SEQ ID NO: | VL Protein SEQ ID NO: | VL FR1 Protein SEQ ID NO: | VL CDR1 Protein SEQ ID NO: | VL FR2 Protein SEQ ID NO: | VL CDR2 Protein SEQ ID NO: | VL FR3 Protein SEQ ID NO: | VL CDR3 Protein SEQ ID NO: | VL FR4 Protein SEQ ID NO: | VL DNA SEQ ID NO: |
|---|---|---|---|---|---|---|---|---|---|---|---|---|
| ADI-57983 (with primer mutation) | | | | 21212 | 21213 | 21214 | 21215 | 21216 | 21217 | 21218 | 21219 | 21220 |
| ADI-57978 (with primer mutation) | | | | 21312 | 21313 | 21314 | 21315 | 21316 | 21317 | 21318 | 21319 | 21320 |
| ADI-56868 (with primer mutation) | | | | 21412 | 21413 | 21414 | 21415 | 21416 | 21417 | 21418 | 21419 | 21420 |
| ADI-56443 (with primer mutation) | | | | 21512 | 21513 | 21514 | 21515 | 21516 | 21517 | 21518 | 21519 | 21520 |
| ADI-56479 (with primer mutation) | | | | 21612 | 21613 | 21614 | 21615 | 21616 | 21617 | 21618 | 21619 | 21620 |

FIG. 36B

| | | | | | | | | | | |
|---|---|---|---|---|---|---|---|---|---|---|
| ADI-58120 | | WT | 21711 | 21712 | 21713 | 21714 | 21715 | 21716 | 21717 | 21718 | 21719 | 21720 |
| ADI-58121 | | YTE | 21811 | 21812 | 21813 | 21814 | 21815 | 21816 | 21817 | 21818 | 21819 | 21820 |
| ADI-58122 | | LA | 21911 | 21912 | 21913 | 21914 | 21915 | 21916 | 21917 | 21918 | 21919 | 21920 |
| ADI-58123 | | LS | 22011 | 22012 | 22013 | 22014 | 22015 | 22016 | 22017 | 22018 | 22019 | 22020 |
| Not assigned | | LA-RE | 22111 | 22112 | 22113 | 22114 | 22115 | 22116 | 22117 | 22118 | 22119 | 22120 |
| ADI-58124 | | WT | 22211 | 22212 | 22213 | 22214 | 22215 | 22216 | 22217 | 22218 | 22219 | 22220 |
| ADI-58125 | | LA | 22311 | 22312 | 22313 | 22314 | 22315 | 22316 | 22317 | 22318 | 22319 | 22320 |
| ADI-58126 | | WT | 22411 | 22412 | 22413 | 22414 | 22415 | 22416 | 22417 | 22418 | 22419 | 22420 |
| ADI-58127 | | LA | 22511 | 22512 | 22513 | 22514 | 22515 | 22516 | 22517 | 22518 | 22519 | 22520 |
| ADI-58128 | | WT | 22611 | 22612 | 22613 | 22614 | 22615 | 22616 | 22617 | 22618 | 22619 | 22620 |
| ADI-58130 | | WT | 22711 | 22712 | 22713 | 22714 | 22715 | 22716 | 22717 | 22718 | 22779 | 22720 |
| ADI-58129 | | LA | 22811 | 22812 | 22813 | 22814 | 22815 | 22816 | 22817 | 22818 | 22819 | 22820 |
| ADI-58131 | | LA | 22911 | 22912 | 22913 | 22914 | 22915 | 22916 | 22917 | 22918 | 22919 | 22920 |
| ADI-58130_LCN30cQ | ADI-58130_LCN30cQ | WT | 23011 | 23012 | 23013 | 23014 | 23015 | 23016 | 23017 | 23018 | 23019 | 23020 |
| ADI-59988 | ADI-58130_LCN30cQ | LA | 23111 | 23112 | 23113 | 23114 | 23115 | 23116 | 23117 | 23118 | 23119 | 23120 |

FIG. 36B CONTINUED

| Test Antigen | ADI-58125 | $K_a$ (1/Ms) | $K_d$ (1/s) | $K_D$ (M) |
|---|---|---|---|---|
| SARS-CoV-2 spike | IgG | 3.66E+06 | 4.94E-05 | 1.35E-11 |
| SARS-CoV-2 spike | Fab | 1.52E+06 | 2.81E-04 | 1.85E-10 |
| SARS-CoV-2 RBD | IgG | 1.53E+06 | 8.79E-05 | 5.74E-11 |
| SARS-CoV-2 RBD | Fab | 1.20E+06 | 3.55E-04 | 2.97E-10 |
| SARS-CoV-1 spike* | IgG | 2.70E+06 | 1.42E-05 | 5.28E-12 |
| SARS-CoV-1 spike | Fab | 6.83E+06 | 5.60E-05 | 8.19E-12 |
| SARS-CoV-1 RBD* | IgG | 9.74E+05 | 1.42E-05 | 1.46E-11 |
| SARS-CoV-1 RBD* | Fab | 1.14E+06 | 2.85E-05 | 2.49E-11 |
| WIV-1 RBD* | IgG | 1.10E+06 | 1.42E-05 | 1.29E-11 |
| WIV-1 RBD* | Fab | 9.91E+05 | 2.85E-05 | 2.87E-11 |

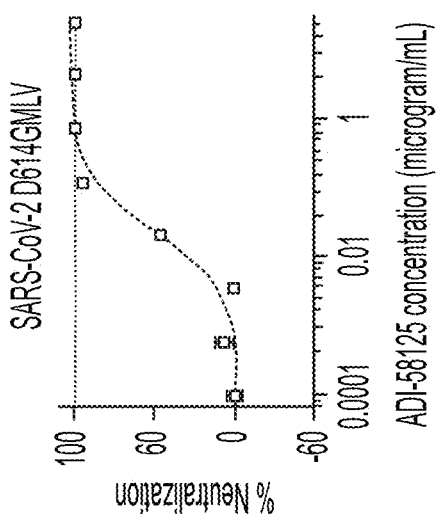
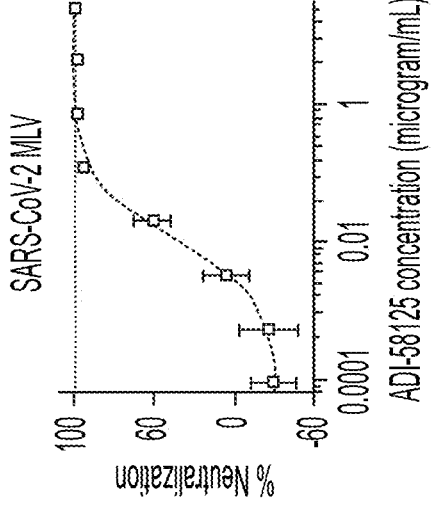
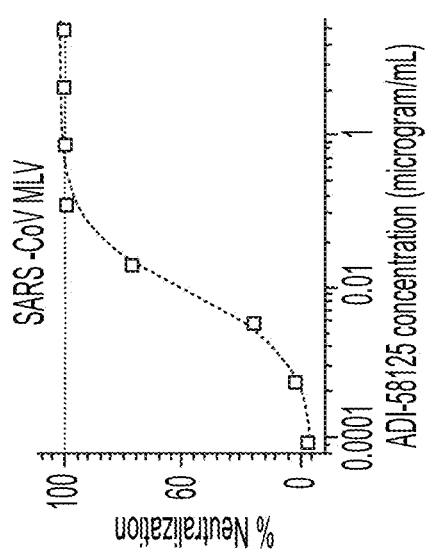
FIG. 39I

Authentic SARS-CoV neutralization

| | ADI-58120 | ADI-58124 | ADI-58126 | ADI-58125 | ADI-57978 | ADI-55689 | ADI-55688 | ADI-56046 | S309 | JS016 | REGN 10987 | REGN 10933 |
|---|---|---|---|---|---|---|---|---|---|---|---|---|
| IC50 (nM) | 0.2799 | 0.06927 | 0.3123 | 0.0803 | 0.05241 | 0.2464 | 0.1431 | 0.9527 | 1.568 | 1247924 | 49708 | 8766 |
| IC50 (ug/mL) | 0.041985 | 0.0103905 | 0.046845 | 0.012045 | 0.0078615 | 0.03696 | 0.021465 | 0.142905 | 0.2352 | 187188.6 | 7456.2 | 1314.9 |

FIG. 39J

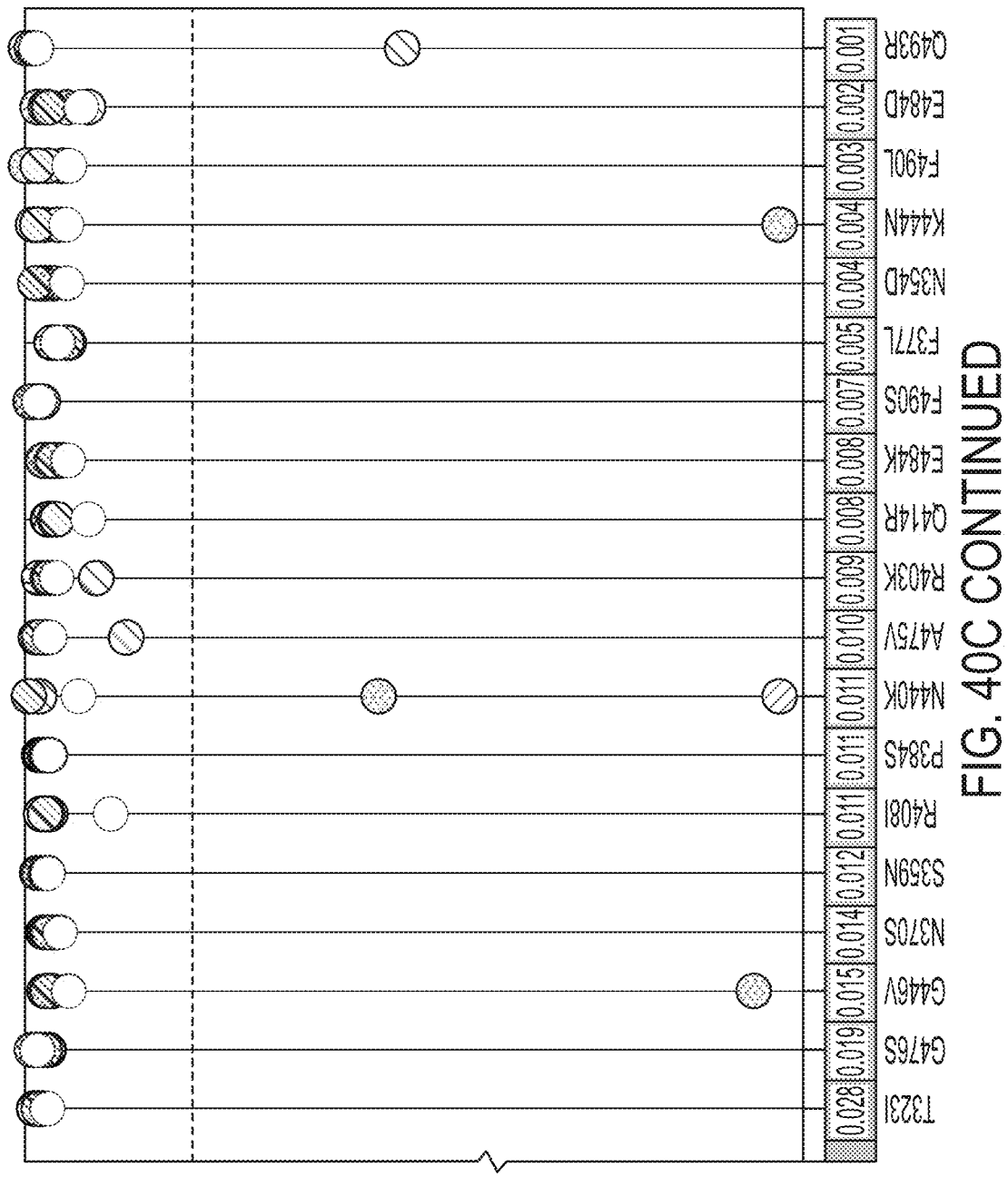

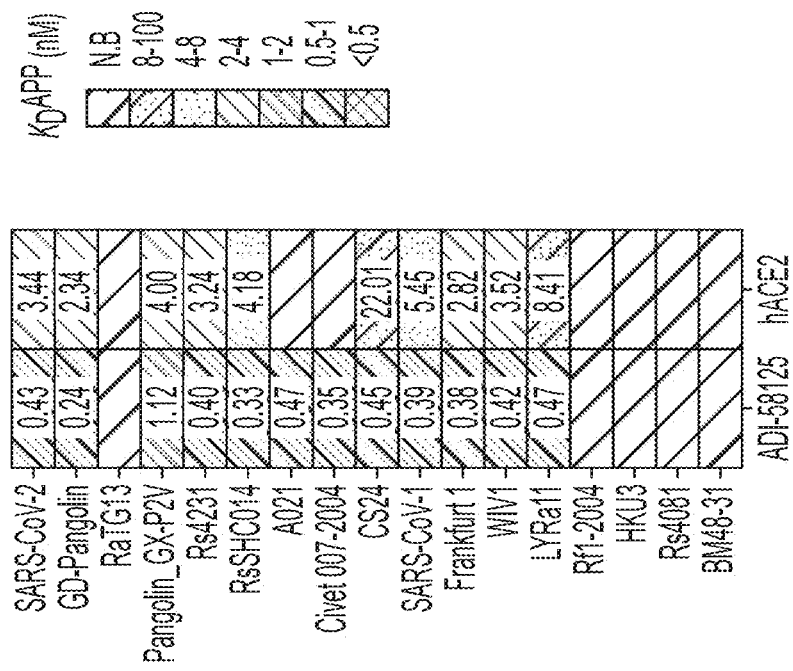
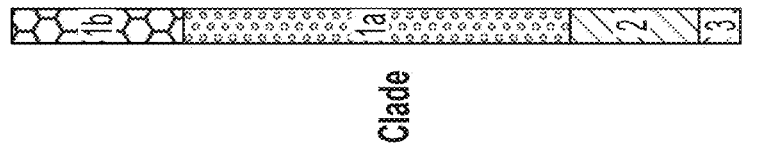
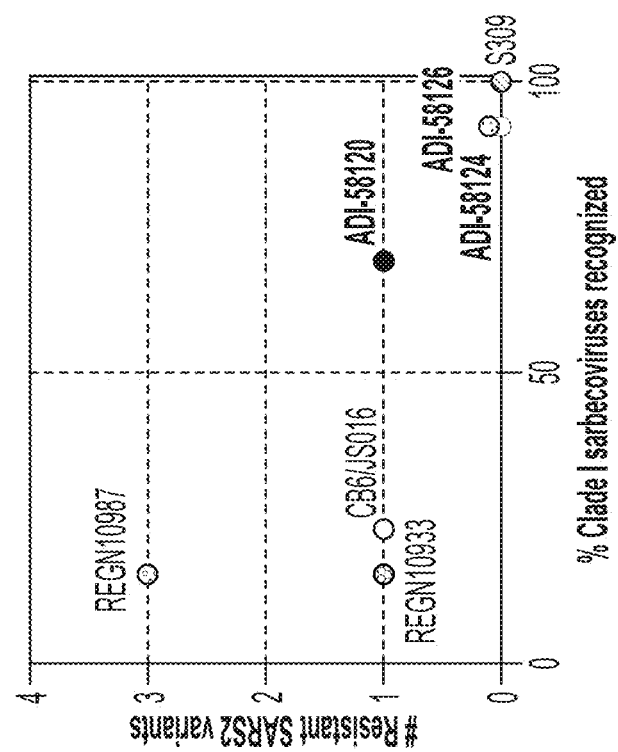
FIG. 40E
FIG. 40D

| KD,app(nM) | SARS-CoV-2 | GD-Pangolin | Pangolin_GX-P2V | RaTG13 | SARS-CoV-1 | Frankfurt 1 | CS24 | Civet 007-2004 |
|---|---|---|---|---|---|---|---|---|
| ADI-58120 | 0.7252 | 0.8664 | N.B. | N.B. | 1.088 | 0.9682 | 0.9685 | 0.7767 |
| ADI-58125 | 0.4331 | 0.2407 | 1.116 | N.B. | 0.3858 | 0.3837 | 0.4548 | 0.3522 |
| ADI-58126 | 0.5453 | 0.6758 | N.B. | 0.8801 | 0.9109 | 0.9637 | 1.048 | 0.8967 |
| S309 | 3.938 | 4.528 | 4.325 | 2.881 | 3.217 | 3.497 | 2.521 | 3.752 |
| REGN10987 | 0.5124 | 1.442 | N.B. | N.B. | N.B. | N.B. | N.B. | N.B. |
| REGN10933 | 0.3248 | 0.6415 | N.B. | 3.597 | N.B. | N.B. | N.B. | N.B. |
| JS016 | 0.664 | 2.148 | N.B. | N.B. | N.B. | N.B. | N.B. | N.B. |
| hACE2 | 3.435 | 2.335 | 3.995 | N.B. | 5.447 | 2.824 | 22.01 | N.B. |

FIG. 40E CONTINUED

| A021 | WIV1 | LYRa11 | RsSHC014 | Rs4231 | HKU3 | Rs4081 | Rf1-2004 | BM48-31 |
|---|---|---|---|---|---|---|---|---|
| 0.947 | 0.6788 | 0.7889 | N.B. | N.B. | N.B. | N.B. | N.B. | N.B. |
| 0.4697 | 0.419 | 0.4733 | 0.3335 | 0.3952 | N.B. | N.B. | N.B. | N.B. |
| 0.9114 | 0.7186 | 0.9152 | 0.9257 | 1.068 | N.B. | N.B. | N.B. | 3.085 |
| 4.142 | 3.887 | 4.531 | 3.751 | 3.772 | N.B. | N.B. | N.B. | N.B. |
| N.B. | N.B. | N.B. | N.B. | N.B. | N.B. | N.B. | N.B. | N.B. |
| N.B. | N.B. | N.B. | N.B. | N.B. | N.B. | N.B. | N.B. | N.B. |
| N.B. | N.B. | N.B. | N.B. | N.B. | N.B. | N.B. | N.B. | N.B. |
| N.B. | 3.515 | 8.413 | 4.18 | 3.239 | N.B. | N.B. | N.B. | N.B. |

FIG. 40E CONTINUED

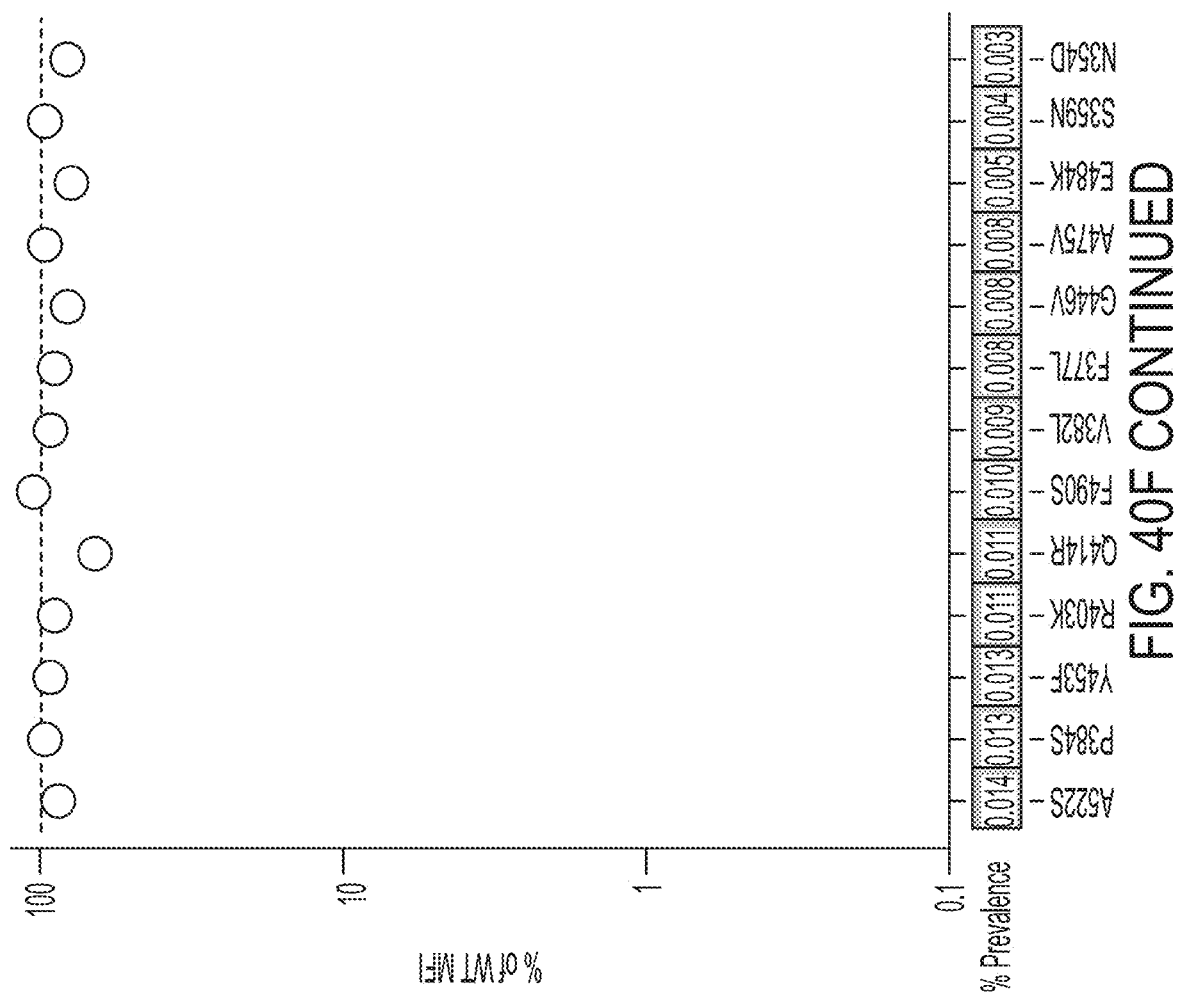

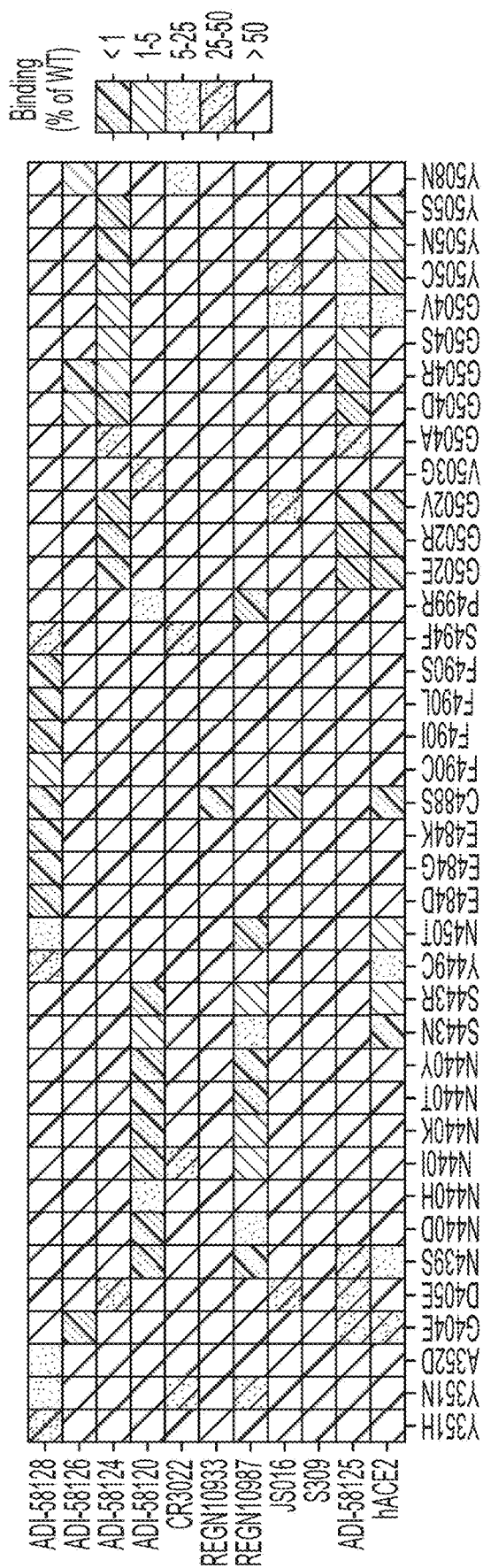
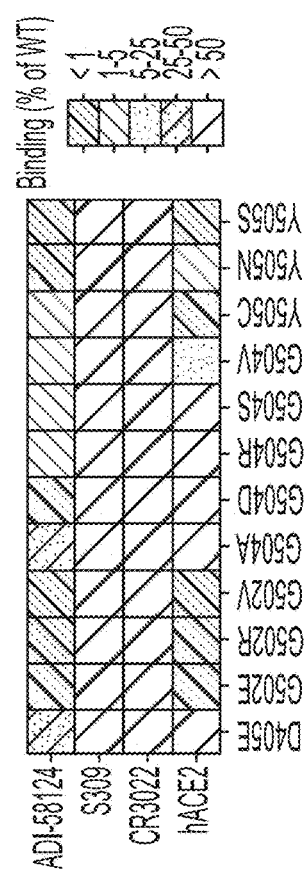
FIG. 41F

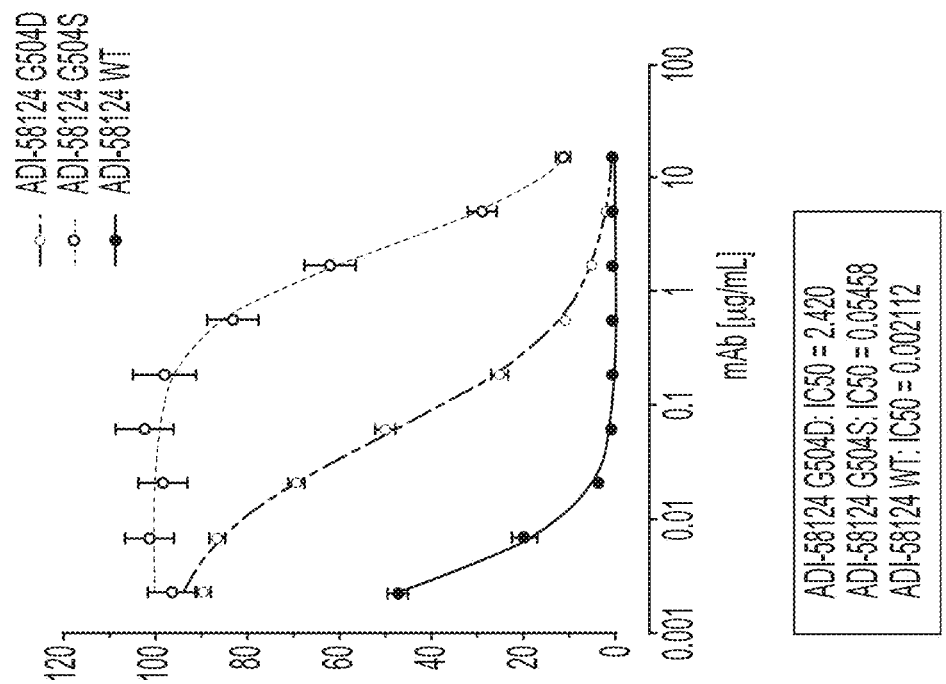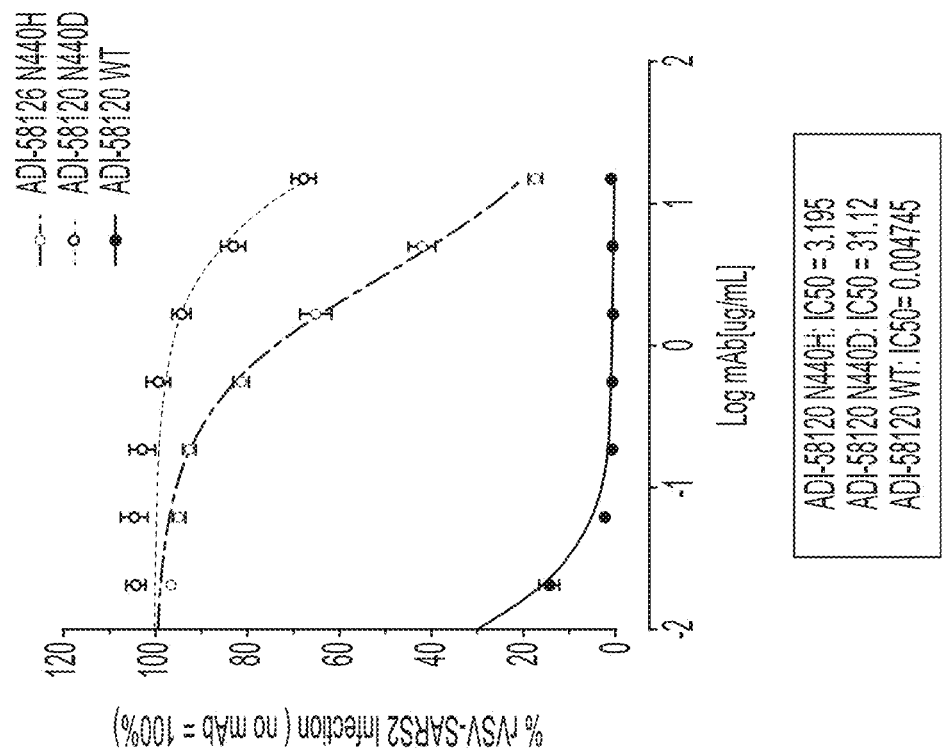
FIG. 41H

| Antibody Name | SARS-2 S Binning | ACE2 Competitor? |
|---|---|---|
| ADI-58124 | 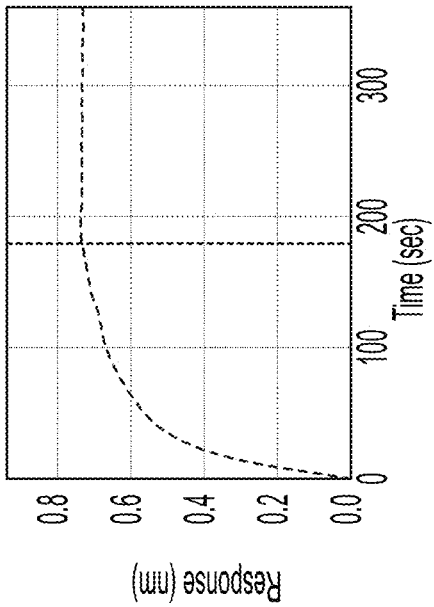 | Yes |
| ADI-58125 | 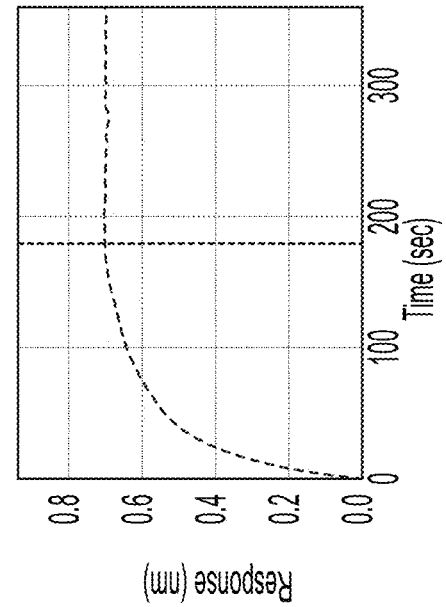 | Yes |
FIG. 42A CONTINUED

| 1st Antibody Name | 2st Antibody Name | Image | Competitor? |
|---|---|---|---|
| REGN10933 | REGN10933 | | Yes |
| JS016 | REGN10933 | | Yes |

FIG. 42C

| 1st Antibody Name | 2st Antibody Name | Image | Competitor? |
|---|---|---|---|
| REGN10933 | JS016 | | Yes |
| JS016 | JS016 | | Yes |

FIG. 42C CONTINUED

| 1st Antibody Name | 2st Antibody Name | Image | Competitor? |
|---|---|---|---|
| REGN10933 | REGN10987 | | No |
| JS016 | REGN10987 | | No |

FIG. 42D

| 1st Antibody Name | 2st Antibody Name | Image | Competitor? |
|---|---|---|---|
| REGN10933 | S309 | | No |
| JS016 | S309 | | No |

FIG. 42D CONTINUED

| 1st Antibody Name | 2st Antibody Name | Image | Competitor? |
|---|---|---|---|
| REGN10933 | ADI-58129 | | Yes |
| JS016 | ADI-58129 | | No |

FIG. 42E

| 1st Antibody Name | 2st Antibody Name | Image | Competitor? |
|---|---|---|---|
| REGN10933 | ADI-58125 | | Yes |
| JS016 | ADI-58125 | | Yes |

FIG. 42E CONTINUED

| 1st Antibody Name | 2st Antibody Name | Image | Competitor? |
|---|---|---|---|
| JS016 | ADI-58126 | | Yes |
| REGN10933 | ADI-58126 | | No |

FIG. 42F

| 1st Antibody Name | 2st Antibody Name | Image | Competitor? |
|---|---|---|---|
| CR3022 | ADI-58126 | | Yes |
| ADI-58126 | ADI-58126 | | Yes |

FIG. 42F CONTINUED

| 1st Antibody Name | 2nd Antibody Name | Image | Competitor? |
|---|---|---|---|
| S309 | CR3022 | 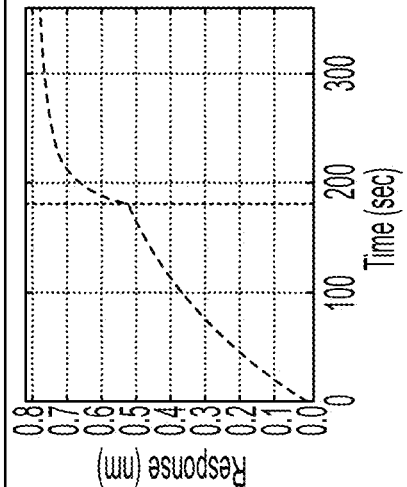 | No |
| ADI-58129 | CR3022 | 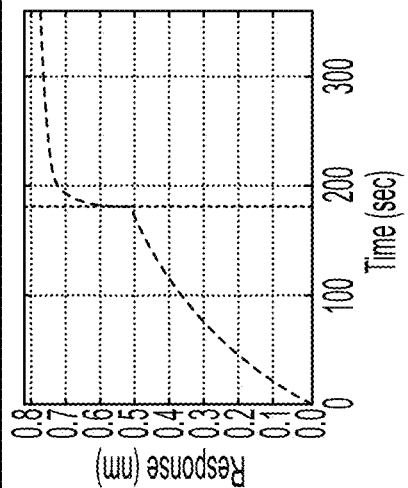 | No |
FIG. 42G

| 1st Antibody Name | 2nd Antibody Name | Image | Competitor? |
|---|---|---|---|
| REGN10933 | ADI-58120 | | No |
| REGN10987 | ADI-58120 | | No |

FIG. 42G CONTINUED

| | hACE2 | ADI-58120 | ADI-58124 | ADI-58126 | ADI-58128 | REGN10933 | REGN10987 | JS016 | S309 | CR3022 |
|---|---|---|---|---|---|---|---|---|---|---|
| hACE2 | Yes | Yes | Yes | Yes | Yes | Yes | Yes | Yes | No | No |
| ADI-58120 | Yes | Yes | Yes | Yes | No | Yes | No | No | Yes | No |
| ADI-58124 | Yes | Yes | Yes | Yes | No | Yes | Yes | Yes | No | No |
| ADI-58126 | Yes | Yes | Yes | No | No | Yes | No | Yes | No | Yes |
| ADI-58128 | Yes | No | No | No | Yes | Yes | No | Yes | No | No |
| REGN10933 | Yes | Yes | Yes | Yes | Yes | No | Yes | No | Yes | No |
| REGN10987 | Yes | No | No | No | No | Yes | Yes | No | No | No |
| JS016 | No | Yes | No | No | No | No | Yes | Yes | Yes | No |
| S309 | No | No | No | No | No | No | No | No | Yes | No |
| CR3022 | No | No | No | Yes | No | No | No | No | No | Yes |

FIG. 42H

| FcγR | Antibody | $k_a$ (1/Ms) | $k_d$ (1/s) | $K_D$ (M) |
|---|---|---|---|---|
| FcγRI | ADI-58125 | 4.87E+06 | 1.71E-04 | 3.51E-11 |
| FcγRI | ADI-58124 | 4.27E+06 | 1.92E-04 | 4.50E-11 |
| FcγRIIA, H167 | ADI-58125 | 1.47E+06 | 6.08E-01 | 4.12E-07 |
| FcγRIIA, H167 | ADI-58124 | 1.12E+06 | 7.46E-01 | 6.65E-07 |
| FcγRIIA, R167 | ADI-58125 | 1.09E+06 | 9.44E-01 | 8.68E-07 |
| FcγRIIA, R167 | ADI-58124 | 1.13E+06 | 1.23E+00 | 1.10E-06 |
| FcγRIIB | ADI-58125 | Non-binder | Non-binder | Non-binder |
| FcγRIIB | ADI-58124 | Non-binder | Non-binder | Non-binder |
| FcγRIIIA, V176 | ADI-58125 | 3.87E+05 | 4.46E-02 | 1.15E-07 |
| FcγRIIIA, V176 | ADI-58124 | 3.24E+05 | 5.86E-02 | 1.81E-07 |
| FcγRIIIA, V176F | ADI-58125 | 3.57E+05 | 1.12E-01 | 3.14E-07 |
| FcγRIIIA, V176F | ADI-58124 | 3.03E+05 | 1.08E-01 | 3.55E-07 |

FIG. 43A

| Antibody | Fc Version | FcRn | $k_a$ (1/Ms) | $k_d$ (1/s) | $K_D$ (M) |
|---|---|---|---|---|---|
| ADI-58124 | WT | Human | 1.26E-07 | 2.43E-01 | 1.93E-08 |
| ADI-58124 | WT | Cyno | | | 1.21E-08* |
| ADI-58125 | LA | Human | 3.27E+07 | 1.00E-01 | 3.06E-09 |
| ADI-58125 | LA | Cyno | 6.20E+07 | 1.45E-01 | 2.34E-09 |

*$K_D$ was derived from steady-state equilibrium analysis, which does not yield $k_a$ and $k_d$ constants.

FIG. 43B

| Antibody | $k_a$ (1/Ms) | $k_d$ (1/s) | $K_D$ (M) |
|---|---|---|---|
| ADI-58124 | 1.66E+05 | 1.31E-02 | 3.53E-09 |
| ADI-58125 | 1.71E+05 | 1.19E-02 | 3.20E-09 |

| Antibody | KD Human FcRn pH 7.4 | KD Human FcRn pH 6.0 | KD cyno FcRn pH 7.4 | KD cyno FcRn pH 7.4 |
|---|---|---|---|---|
| ADI-58124 | N.B. | 1.38E-08 | N.B. | 1.26E-08 |
| ADI-58125 | N.B. | 2.18E-09 | N.B. | 1.84E-09 |

N.B. = non-binding under the conditions of the assay

FIG. 43C

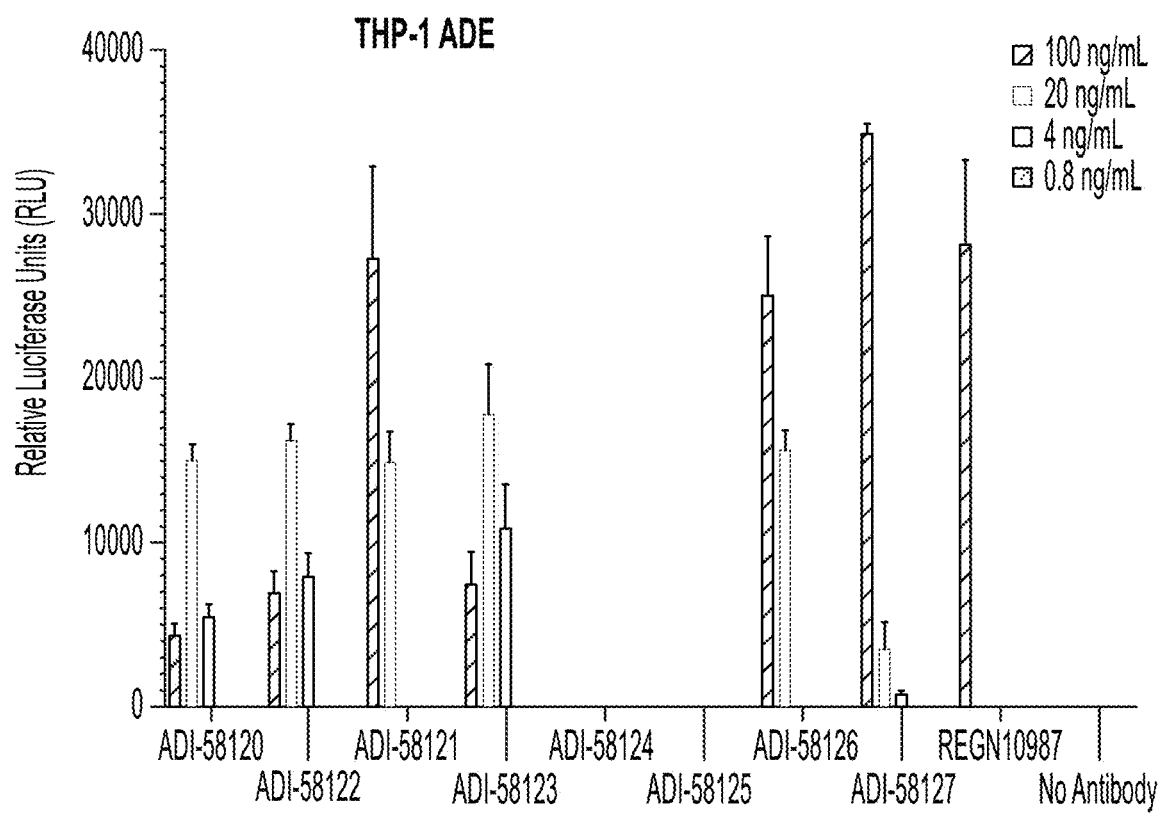
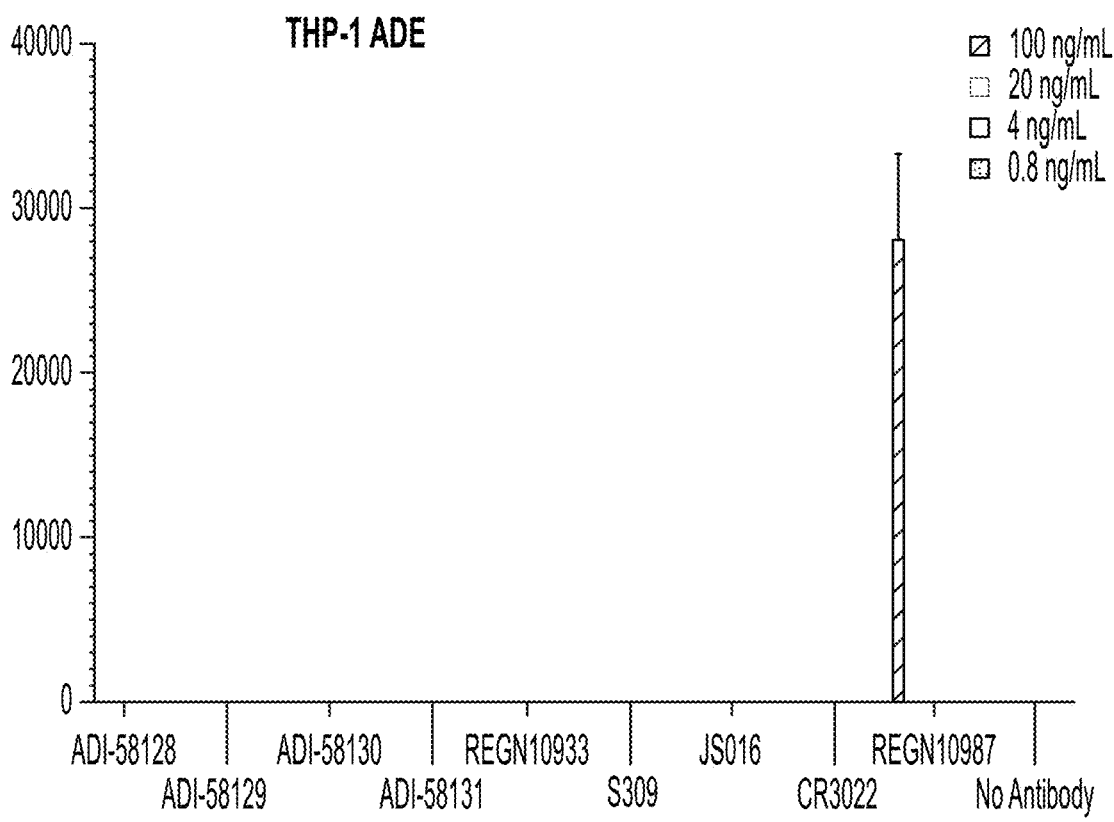
FIG. 45A

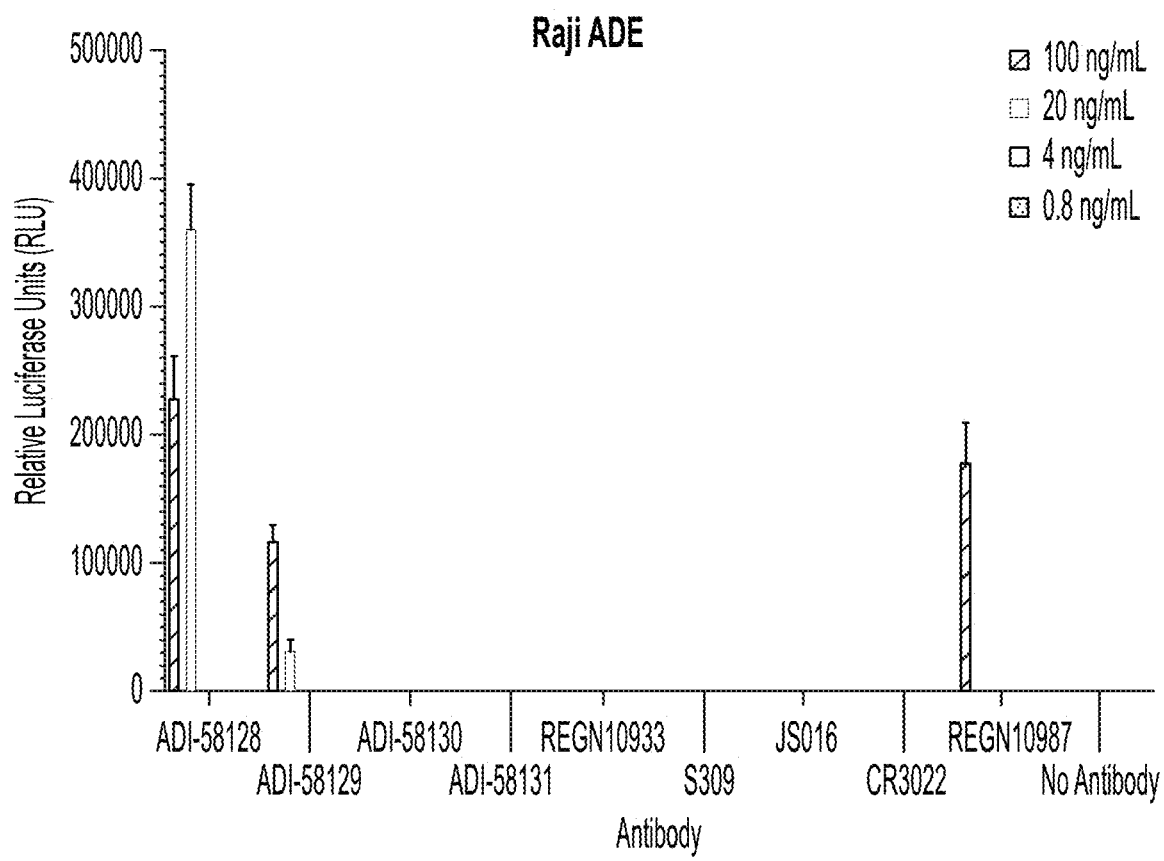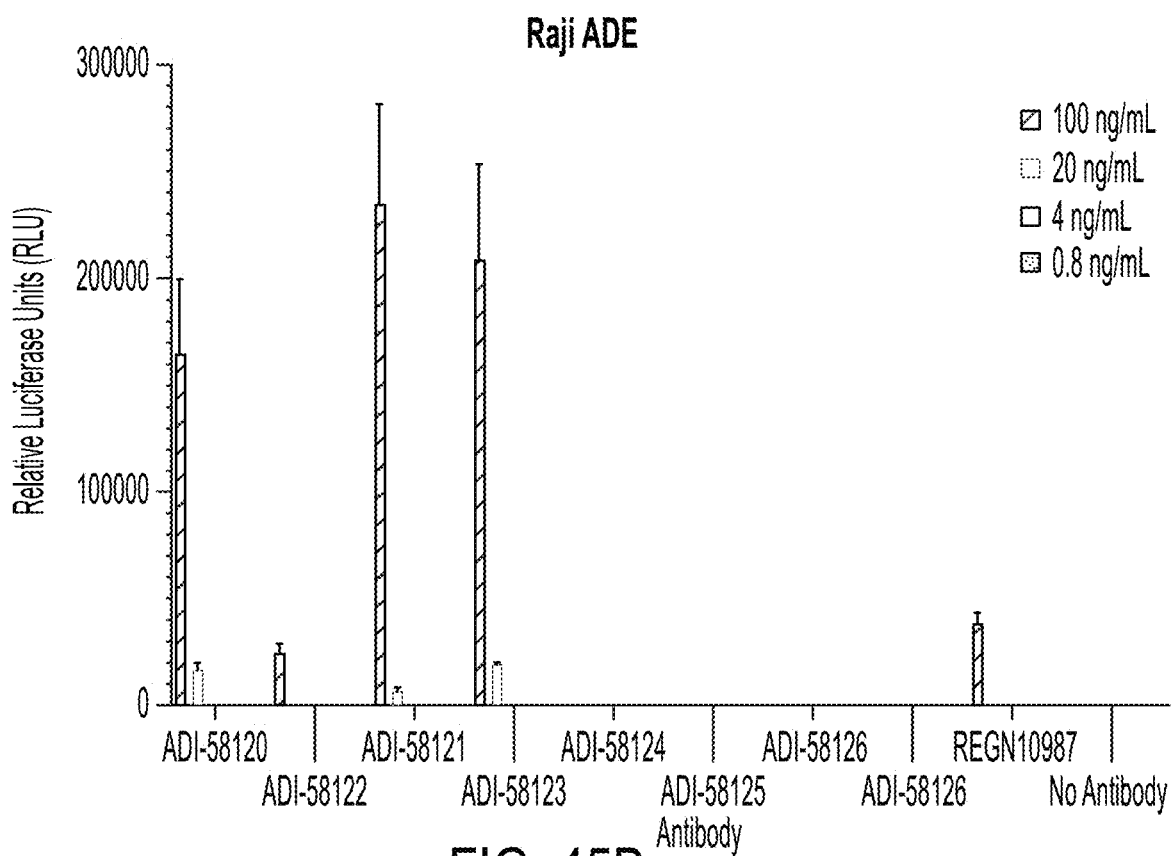
FIG. 45B

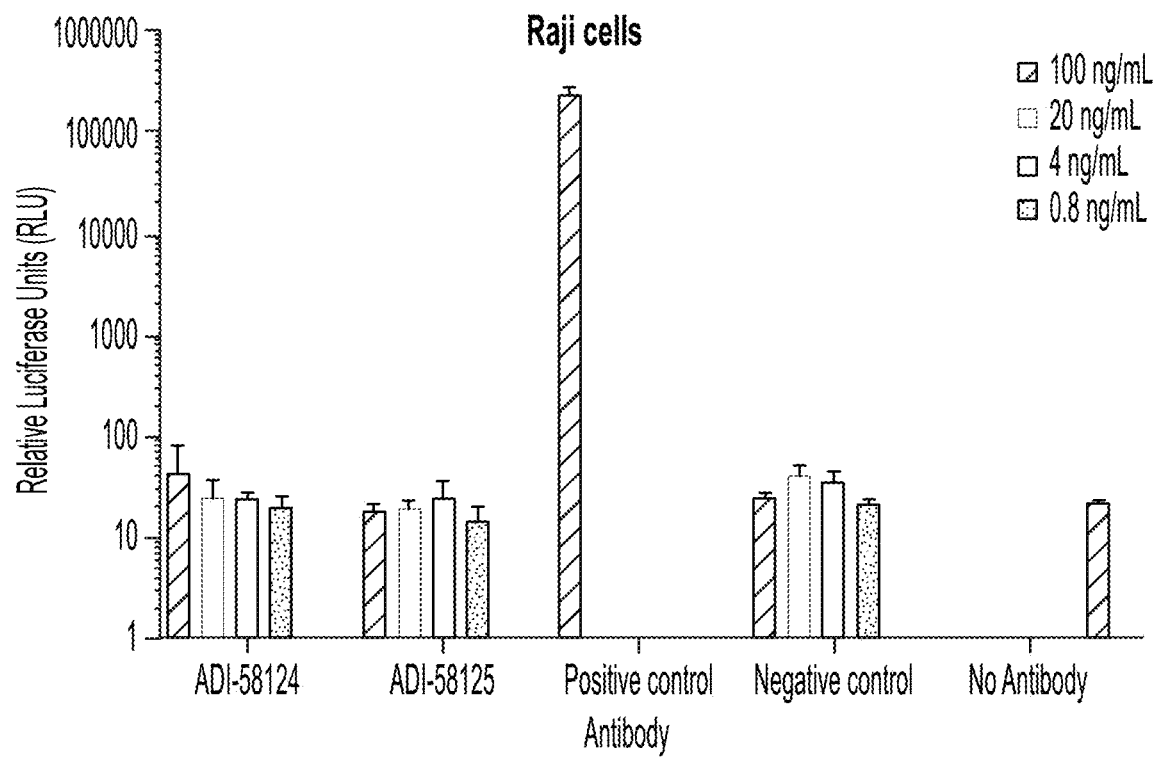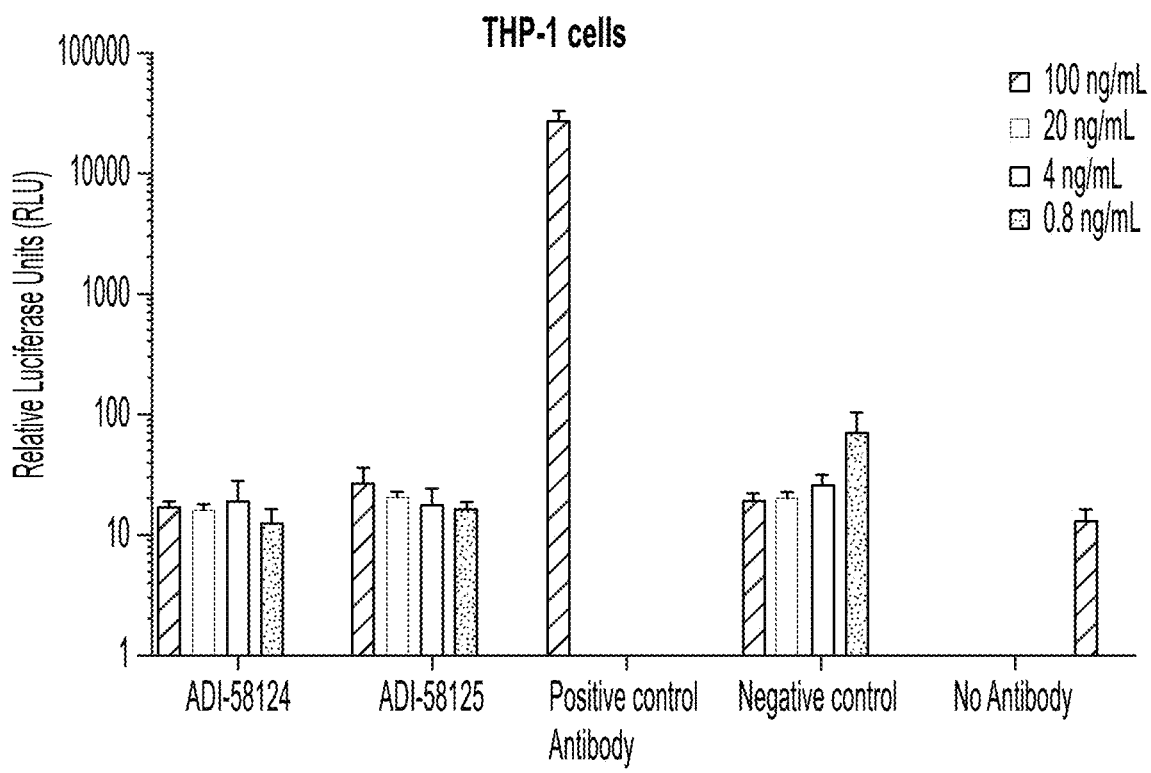
FIG. 45C

Mean pharmacokinetic parameters of ADI-58125 in male and female Cynomolgus Monkeys (n=5)

| Group | 1 | | 2 | |
|---|---|---|---|---|
| Route | IV infusion | | IM | |
| Dose (mg/kg) | 10 | | 10 | |
| PK | Mean | SD | Mean | SD |
| $C_{max}$ (ug/mL) | 226 | 19.7 | 114 | 8.34 |
| $C_{last}$ (ug/mL) | 4.48 | 2.53 | 6.25 | 1.81 |
| $T_{max}$ (h) | 1.00 | 0.00 | 62.4 | 32.2 |
| $T_{1/2}$ (h) | 473 | 104 | 533 | 85.3 |
| $Vd_{ss}$ (mL/kg) | 83.7 | 5.01 | -- | -- |
| $V_z$ (mL/kg) | 83.0 | 13.1 | -- | -- |
| Cl (mL/h/kg) | 0.126 | 0.0365 | -- | -- |
| $AUC_{0-last}$ (ug·h/mL) | 80500 | 17600 | 88100 | 6340 |
| $AUC_{0-inf}$ (ug·h/mL) | 83800 | 19500 | 92900 | 7130 |
| Bioavailability (%)a | -- | -- | 111 | -- |

"--" means not applicable due to less than 3 quantifiable values a: Bioavailability (%) was calculated with mean $AUC_{0-inf}$ and nominal dose

FIG. 49B

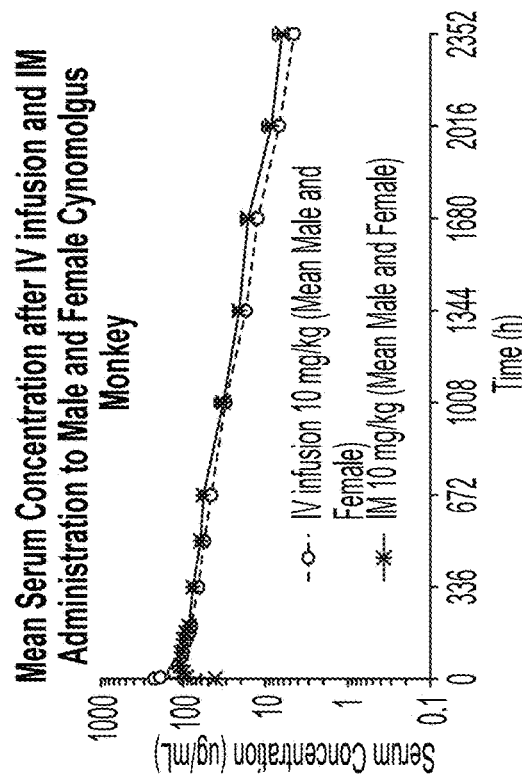

FIG. 49A

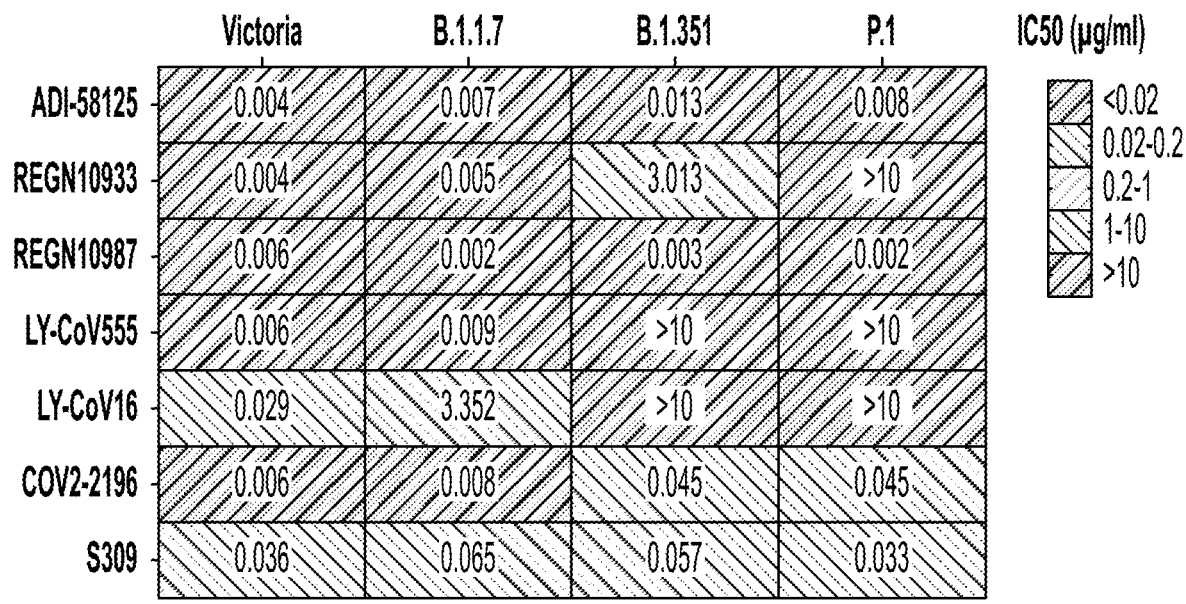
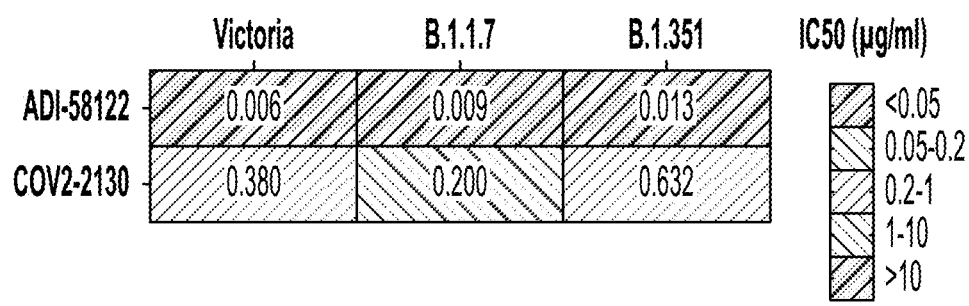
FIG. 50A

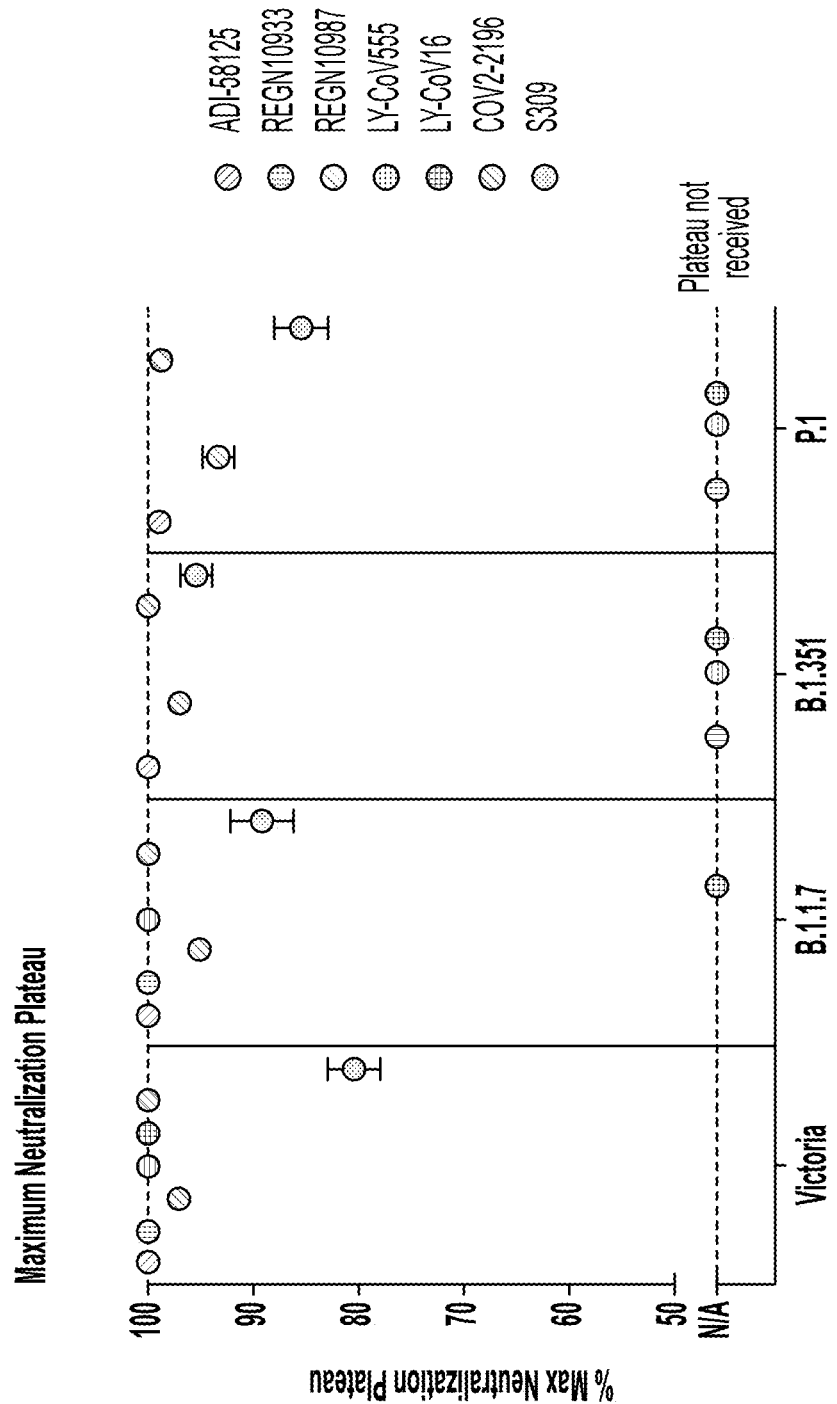

COMPOUNDS SPECIFIC TO CORONAVIRUS S PROTEIN AND USES THEREOF

RELATED APPLICATIONS

This application claims the benefit of priority to U.S. Provisional Application No. 63/008,545, filed on Apr. 10, 2020, to U.S. Provisional Application No. 63/021,589, filed on May 7, 2020, to U.S. Provisional Application No. 63/046,313, filed on Jun. 30, 2020, to U.S. Provisional Application No. 63/112,122, filed on Nov. 10, 2020, to U.S. Provisional Application No. 63/138,886, filed on Jan. 19, 2021, to U.S. Provisional Application No. 63/143,456, filed on Jan. 29, 2021, to U.S. Provisional Application No. 63/147,495, filed on Feb. 9, 2021, to U.S. Provisional Application No. 63/148,754, filed on Feb. 12, 2021, to U.S. Provisional Application No. 63/150,413, filed on Feb. 17, 2021, to U.S. Provisional Application No. 63/152,054, filed on Feb. 22, 2021, and U.S. Provisional Application No. 63/163,400, filed on Mar. 19, 2021. The entire contents of each of these applications are incorporated herein by reference.

SEQUENCE LISTING

The instant application contains a Sequence Listing which has been submitted electronically in ASCII format and is hereby incorporated by reference in its entirety. Said ASCII copy, created on Apr. 8, 2021, is named 132280-00113_SL.txt and is 2,710,434 bytes in size.

FIELD

This disclosure generally pertains to antibodies and antigen-binding fragments thereof, preferably human antibodies and antigen-binding fragments and/or affinity-matured variants thereof, recombinant cells engineered to express such antibodies, and compositions containing such antibodies and antigen-binding fragments thereof, wherein such antibodies and antigen-binding fragments thereof specifically bind to the S protein of coronaviruses ("CoV-S") and therapeutic and diagnostic uses for the antibodies, antigen-binding fragments, and compositions thereof.

BACKGROUND

Coronaviruses ("CoV") are genetically classified into four major genera: the *Alphacoronavirus* genus (ACoV genus); the *Betacoronavirus* genus (BCoV genus); the *Gammacoronavirus* genus (CCoV genus); and *Deltacoronavirus* genus (DCoV genus), and while ACoV and BCoV primarily infect mammals CCoV and DCoV predominantly infect birds (Wu A. et al., Cell Host Microbe. Mar. 11, 2020; 27(3):325-328). Coronaviruses that infect humans were first identified in the mid-1960s, and currently, seven confirmed CoV species are known as human pathogens. Four CoV species, the HCoV-HKU1 and HCoV-OC43 from the BCoV genus and the HCoV-229E and HCoV-NL63 from the ACoV genus, are endemic species in humans and cause mild respiratory symptoms, mostly in pediatric patients (Brielle E. S., et al., BioRxiv reprint, doi: https://doi.org/10.1101/2020.03.10.986398). The other three human CoV species, the SARS-CoV, the MERS-CoV, and the SARS-CoV-2 (also known as "2019-nCoV"), all of which are from the BCoV genus, have caused severe outbreaks, including the Severe Acute Respiratory Syndrome (SARS) outbreak in 2002-2003, the Middle East Respiratory Syndrome (MERS) outbreak in 2012-2013, and the current (2019-) pandemic of the coronavirus disease of 2019 ("COVID-19").

The genome of coronaviruses, whose size ranges between approximately 26,000 and 32,000 bases, includes a variable number (from 6 to 11) of open reading frames ("ORFs") (Wu A. et al., Cell Host Microbe. Mar. 11, 2020; 27(3):325-328). The first ORF encodes 16 non-structural proteins ("nsps"), and the remaining ORFs encode accessory proteins and structural proteins. The four major structural proteins are the spike surface glycoprotein ("S protein" or "S" or "spike protein"), small envelope protein ("E protein" or "E"), matrix protein ("M protein" or "M"), and nucleocapsid protein ("N protein", or "N").

The S protein, which plays an essential role in binding to receptors on the host cell and determines host tropism (Zhu Z. et al., Infect Genet Evol. 2018 July; 61:183-184), forms homotrimers protruding from the viral surface (Li F. *Annu Rev Virol.* Sep. 29, 2016; 3(1):237-261). The S protein is processed into two non-covalently associated subunits, 51 and S2, and each monomer in the trimeric S assembly is a heterodimer of S1 and S2 subunits. Cryo-EM studies have revealed that the 51 subunit is comprised of four domains: an N-terminal domain (NTD), a C-terminal domain (CTD), and two subdomains (Walls A. C. et al., *Nature* 531, 114-117 (2016); Tortorici M. A. and Veesler D., *Adv Virus Res.* 2019; 105:93-116; Wrapp D. et al., *Science* 367, 1260-1263 (2020)). The CTD functions as the receptor-binding domain (RBD) for both SARS-CoV and SARS-CoV-2 (Li F. *J Virol.* 2015 February; 89(4):1954-64). The S2 subunit contains the fusion peptide, heptad repeat 1 and 2, and a transmembrane domain, all of which are required to mediate fusion of the viral and host cell membranes.

SARS-CoV and SARS-CoV-2 bind to and use angiotensin-converting enzyme 2 (ACE2) of a host cell as a receptor to enter the host cells (Ge X. Y. et al., Nature. Nov. 28, 2013; 503(7477):535-8; Hoffmann M. et al., Cell. Mar. 4, 2020. pii: 50092-8674(20)30229-4). The motif within the RBD that particularly binds to RCE2 is often referred to as the "ACE2-binding motif". SARS-CoV can also use CD209L (also known as L-SIGN) as an alternative receptor (Jeffers S. A. et al., Proc Natl Acad Sci USA. Nov. 2, 2004; 101(44):15748-53). In contrast, MERS-CoV binds dipeptidyl peptidase 4 ("DPP4", also known as CD26) of the host cell via a different RBD of the S protein.

Cell entry of coronaviruses often depends also on priming of the S protein by host cell proteases. Recently, SARS-CoV-2 was found to use the serine protease TMPRSS2 for S protein priming and ACE2 for entry (Wu A. et al., Cell Host Microbe. Mar. 11, 2020; 27(3):325-328; Hoffmann M. et al., Cell. Mar. 4, 2020. pii: 50092-8674(20)30229-4).

The genome of SARS-CoV-2 is about 29.8 kb nucleotides and encodes 15 nsps, four structural proteins (S, E, M, and N) and eight accessory proteins (3a, 3b, p6, 7a, 7b, 8b, 9b, and orf14) (Wu A. et al., Cell Host Microbe. Mar. 11, 2020; 27(3):325-328). While SARS-CoV-2 is genetically close to a SARS-like bat CoV and also to SARS-CoV, a number of sequence differences have been identified. When SARS-CoV-2 is compared to SARS-CoV or SARS-like bat CoV, 380 amino acid differences or substitutions were found, 27 of which are in the S protein, including 6 substitutions in the RBD at amino acid region 357-528 (but not in the receptor-binding motifs that directly interact with ACE2) and 6 substitutions in the underpinning subdomain (SD) at amino acid region 569-655.

One of the few drugs approved by the U.S. Food and Drug Administration ("FDA") for use in treating COVID-19 is the viral replication inhibitor remdesivir. Clinical trials demonstrated that remdesivir shortens the time to recovery in hospitalized patients, but more effective therapy is in great need. Convalescent plasma received the emergency use authorization status by the FDA. Other treatments given to COVID-19 patients include anti-inflammatories such as corticosteroids and other treatments for managing symptoms such as supplemental oxygen and mechanical ventilatory support. Several drugs, particularly those that have been approved for preventing or treating other infectious disease, are currently being tested in the clinic, which includes e.g., lopinavir-ritonavir (HIV protease inhibitor), ABX464 (viral RNA splicer), favilavir (RNA-dependent RNA polymerase inhibitor used for influenza virus infection), niclosamide and ivermectin (antihelmintic), and BCG vaccine (vaccine for tuberculosis). Also, other ongoing clinical trials reportedly are using IL-6 receptor antagonist antibodies, an anti-GM-CSF or anti-GM-CSF receptor antibody, an anti-TNF antibody, an anti-IL-1beta antibody, or an anti-complement component 5 antibody, in an effort to inhibit inflammation and thereby potentially inhibit cytokine storm and sepsis which can manifest in some SARS-CoV-2-infected patients and may cause death.

SUMMARY

In one aspect, the present disclosure relates to a compound which binds to coronavirus "(CoV) or the spike protein (S protein) of a CoV (CoV-S"). In some embodiments, the compound may be an isolated antibody or antigen-binding antibody fragment which binds to a CoV-S. In some embodiments, the antibody or antigen-binding antibody fragment may comprise a heavy chain variable region (VH), or fragments thereof, and/or a light chain variable region (VL), or fragments thereof. In certain embodiments, the VH or fragment thereof may comprise a complementarity-determining region 1 (CDR1), a complementarity-determining region 2 (CDR2), and a complementarity-determining region 3 (CDR3), which may also be referred to as VH CDR1, VH CDR2, and VH CDR3, respectively. In certain embodiments, the VL or fragment thereof may comprise a CDR1, a CDR2, and a CDR3, which may also be referred to as VL CDR1, VL CDR2, and VL CDR3, respectively. In some embodiments, the antibody, or antigen-binding antibody fragment thereof, may comprise a heavy chain CDR1, a heavy chain CDR2, a heavy chain CDR3, a light chain CDR1, a light chain CDR2, and a light chain CDR3.

In some embodiments, the antibody or antigen-binding antibody fragment may comprise an antibody or antigen-binding antibody fragment thereof, or an affinity-matured variant of an anti-CoV-S antibody or antigen-binding antibody fragment thereof; selected from the group consisting of ADI-55688, ADI-55689, ADI-55690, ADI-55691, ADI-55692, ADI-55693, ADI-55694, ADI-55695, ADI-55696, ADI-55697, ADI-55698, ADI-55699, ADI-55700, ADI-55701, ADI-55702, ADI-55703, ADI-55704, ADI-55705, ADI-55706, ADI-55707, ADI-55708, ADI-55709, ADI-55710, ADI-55711, ADI-55712, ADI-55713, ADI-55714, ADI-55715, ADI-55716, ADI-55717, ADI-55718, ADI-55719, ADI-55721, ADI-55722, ADI-55723, ADI-55724, ADI-55725, ADI-55726, ADI-55727, ADI-55728, ADI-55729, ADI-55730, ADI-55731, ADI-55732, ADI-55733, ADI-55734, ADI-55735, ADI-55736, ADI-55737, ADI-55738, ADI-55739, ADI-55740, ADI-55741, ADI-55742, ADI-55743, ADI-55744, ADI-55745, ADI-55746, ADI-55747, ADI-55748, ADI-55749, ADI-55750, ADI-55751, ADI-55752, ADI-55753, ADI-55754, ADI-55755, ADI-55756, ADI-55757, ADI-55758, ADI-55720, ADI-55760, ADI-55761, ADI-55762, ADI-55763, ADI-55765, ADI-55766, ADI-55767, ADI-55769, ADI-55770, ADI-55771, ADI-55775, ADI-55776, ADI-55777, ADI-55950, ADI-55951, ADI-55952, ADI-55953, ADI-55954, ADI-55955, ADI-55956, ADI-55957, ADI-55958, ADI-55959, ADI-55960, ADI-55961, ADI-55962, ADI-55963, ADI-55964, ADI-55965, ADI-55966, ADI-55967, ADI-55968, ADI-55969, ADI-55970, ADI-55972, ADI-55973, ADI-55974, ADI-55975, ADI-55976, ADI-55977, ADI-55978, ADI-55979, ADI-55980, ADI-55981 ADI-55982, ADI-55984, ADI-55986, ADI-55988, ADI-55989, ADI-55990, ADI-55992, ADI-55993, ADI-55994, ADI-55995, ADI-55996, ADI-55997, ADI-55998, ADI-55999, ADI-56000, ADI-56001, ADI-56002, ADI-56003, ADI-56004, ADI-56005 ADI-56006, ADI-56007, ADI-56008, ADI-56009, ADI-56010, ADI-56011, ADI-56012, ADI-56013, ADI-56014, ADI-56015, ADI-56016, ADI-56017, ADI-56018, ADI-56019, ADI-56020, ADI-56021, ADI-56022, ADI-56023, ADI-56024, ADI-56025, ADI-56026, ADI-56027, ADI-56028, ADI-56029, ADI-56030, ADI-56031, ADI-56032, ADI-56033, ADI-56034, ADI-56035, ADI-56037, ADI-56038, ADI-56039, ADI-56040, ADI-56041, ADI-56042, ADI-56043, ADI-56044, ADI-56045, ADI-56046, ADI-56047, ADI-56048, ADI-56049, ADI-56050, ADI-56051, ADI-56052, ADI-56053, ADI-56054, ADI-56055, ADI-56056, ADI-56057, ADI-56058, ADI-56059, ADI-56061, ADI-56062, ADI-56063, ADI-56064, ADI-56065, ADI-56066, ADI-56067, ADI-56068, ADI-56069, ADI-56070, ADI-56071, ADI-56072, ADI-56073, ADI-56074, ADI-56075 ADI-56076, ADI-56078, ADI-56079, ADI-56080, ADI-56081, ADI-56082, ADI-56083, ADI-56084, ADI-56443, ADI-56479, ADI-58120, ADI-58121, ADI-58122, ADI-58123, ADI-58124, ADI-58125, ADI-58126, ADI-58127, ADI-58128, ADI-58129, ADI-58130, ADI-58131, ADI-58130_LCN30cQ, and ADI-59988, optionally wherein the CoV-S is SARS-CoV-S or SARS-CoV-2-S.

In particular embodiments, the antibody or antigen-binding antibody fragment may comprise ADI-55688, ADI-55689, ADI-55690, ADI-55951, ADI-55993, ADI-56000, ADI-56010, ADI-56032, or ADI-56046, or an antigen-binding antibody fragment thereof; or an affinity-matured variant of an anti-CoV-S antibody selected from the group consisting of ADI-55688, ADI-55689, ADI-55690, ADI-55951, ADI-55993, ADI-56000, ADI-56010, ADI-56032, and ADI-56046.

In particular embodiments, the antibody or antigen-binding antibody fragment may comprise ADI-55689, ADI-55688, or ADI-56046, or an antigen-binding antibody fragment thereof, or an affinity-matured variant of an anti-CoV-S antibody ADI-55689, ADI-55688, or ADI-56046, or an antigen-binding antibody fragment thereof.

In further particular embodiments, the affinity-matured variant may be ADI-57983 (with primer mutation), ADI-57978 (with primer mutation), ADI-56868 (with primer mutation), ADI-58120, ADI-58121, ADI-58122, ADI-58123, ADI-58124, ADI-58125, ADI-58126, ADI-58127, ADI-58128, ADI-58129, ADI-58130, ADI-58131, ADI-58130_LCN30cQ, or ADI-59988.

In some embodiments, the antibody, or antigen-binding antibody fragment thereof, may comprise a VH and/or VL. In certain embodiments, the VH may comprise a CDR3 having an amino acid sequence identical to the VH CDR3 of any one of anti-CoV-S antibodies described herein and in FIGS. 1, 2 and 36, and optionally, the VL CDR3 may comprise a CDR3 having an amino acid sequence identical to the VL CDR3 of the same anti-CoV-S antibody that the VH CDR3 is derived from, and the anti-CoV-S antibody may be selected from any one of anti-CoV-S antibodies described herein and in FIGS. 1, 2 and 36. Here, the CoV-S may be the spike protein ("S protein") of Severe Acute Respiratory Syndrome (SARS) coronavirus ("SARS-CoV"), which may be referred to as "SARS-CoV-S", or the S protein of SARS-CoV-2 (also known as "n2019-nCoV"), which may be referred to as "SARS-CoV-2-S". Optionally, the CoV-S may comprise a sequence having at least 90%, 91%, 92%, 93%, 94%, 95%, 96%, 97%, 98%, 99% identity to, comprising, or consisting of the amino acid sequence of SEQ ID NO: 1 (SARS-CoV-S, 1288 amino acids, Accession #PDB: 6VSB_B) or having at least 90%, 91%, 92%, 93%, 94%, 95%, 96%, 97%, 98%, 99% identity to, comprising, or consisting of SEQ ID NO: 5 (SARS-CoV-2-S, 1273 amino acids, GenBank: QHD43416.1).

In some preferred embodiments, the VH comprises a CDR3 having an amino acid sequence identical to the VH CDR3 of an anti-CoV-S antibody selected from the group consisting of ADI-55688, ADI-55689, ADI-55690, ADI-55951, ADI-55993, ADI-56000, ADI-56010, ADI-56032, ADI-56046, ADI-57983 (with primer mutation), ADI-57978 (with primer mutation), ADI-56868 (with primer mutation), ADI-56443 (with primer mutation), ADI-56479 (with primer mutation), ADI-58120, ADI-58121, ADI-58122, ADI-58123, ADI-58124, ADI-58125, ADI-58126, ADI-58127, ADI-58128, ADI-58129, ADI-58130, ADI-58131, ADI-58130_LCN30cQ, and ADI-59988. Optionally, the VL comprises a VL CDR3 having an amino acid sequence identical to the CDR3 of the same anti-CoV-S antibody from which the VH CDR3 is derived.

Further optionally, the isolated antibody or antigen-binding antibody fragment may (a) cross-react with SARS-CoV-S and SARS-CoV-2-S; and (b) may comprise the same VH CDR3 polypeptide sequence as ADI-55708, ADI-55709, or ADI-55719, which is ARGSLSREYDFL-TAPQNGPWFDS (SEQ ID NO: 2108, 2208, or 3208); and optionally (c) may further comprise the same VH CDR1 polypeptide sequence as ADI-55708, ADI-55709, or ADI-55719VH.

In some embodiments, the antibody or antigen-binding antibody fragment, optionally an affinity-matured variant of any of the anti-CoV-S antibodies disclosed herein, may comprise at least 1, 2, 3, 4, 5 or all 6 complementarity-determining regions (CDRs) of any one of anti-CoV-S antibodies described herein and in FIGS. 1, 2 and 36, optionally wherein the CoV-S is SARS-CoV-S or SARS-CoV-2-S. Optionally, the CoV-S may comprise the amino acid sequence of SEQ ID NO: 1 (SARS-CoV-S, 1288 amino acids, Accession #PDB: 6VSB_B) or SEQ ID NO: 5 (SARS-CoV-2-S, 1273 amino acids, GenBank: QHD43416.1).

In some preferred embodiments, the antibody or antigen-binding antibody fragment comprises at least 1, 2, 3, 4, 5 or all 6 complementarity-determining regions (CDRs) of an anti-CoV-S antibody selected from the group consisting of ADI-55688, ADI-55689, ADI-55690, ADI-55951, ADI-55993, ADI-56000, ADI-56010, ADI-56032, ADI-56046, ADI-57983 (with primer mutation), ADI-57978 (with primer mutation), ADI-56868 (with primer mutation), ADI-56443 (with primer mutation), ADI-56479 (with primer mutation), ADI-58120, ADI-58121, ADI-58122, ADI-58123, ADI-58124, ADI-58125, ADI-58126, ADI-58127, ADI-58128, ADI-58129, ADI-58130, ADI-58131, ADI-58130_LCN30cQ, and ADI-59988.

In some embodiments, the isolated antibody or antigen-binding antibody fragment, optionally an affinity-matured variant of any of the anti-CoV-S antibodies disclosed herein, may comprise: (a) a VH CDR1 polypeptide; (b) a VH CDR2 polypeptide; (c) a VH CDR3 polypeptide; (d) a VL CDR1 polypeptide; (e) a VL CDR2 polypeptide; and (f) a VL CDR3 polypeptide. The amino acid sequences of the VH CDR1, the VH CDR2, the VH CDR3, the VL CDR1, the VL CDR2, and the VL CDR3 may be identical to the amino acid sequences of the VH CDR1, VH CDR2, VH CDR3, VL CDR1, VL CDR2, and VL CDR3, respectively, of any one of anti-CoV-S antibodies described herein and in FIGS. 1, 2 and 36. Optionally, the CoV-S may be SARS-CoV-S or of "SARS-CoV-2-S". Further optionally, the CoV-S may comprise the amino acid sequence of SEQ ID NO: 1 (SARS-CoV-S, 1288 amino acids, Accession #PDB: 6VSB_B) or SEQ ID NO: 5 (SARS-CoV-2-S, 1273 amino acids, GenBank: QHD43416.1).

In particular embodiments, the amino acid sequences of the VH CDR1, the VH CDR2, the VH CDR3, the VL CDR1, the VL CDR2, and the VL CDR3 may be identical to the amino acid sequences of the VH CDR1, VH CDR2, VH CDR3, VL CDR1, VL CDR2, and VL CDR3, respectively, of an anti-CoV-S antibody selected from the group consisting of ADI-55688, ADI-55689, ADI-55690, ADI-55951, ADI-55993, ADI-56000, ADI-56010, ADI-56032, ADI-56046, ADI-57983 (with primer mutation), ADI-57978 (with primer mutation), ADI-56868 (with primer mutation), ADI-56443 (with primer mutation), ADI-56479 (with primer mutation), ADI-58120, ADI-58121, ADI-58122, ADI-58123, ADI-58124, ADI-58125, ADI-58126, ADI-58127, ADI-58128, ADI-58129, ADI-58130, ADI-58131, ADI-58130_LCN30cQ, and ADI-59988.

In further particular embodiments, the amino acid sequences of the VH CDR1, the VH CDR2, the VH CDR3, the VL CDR1, the VL CDR2, and the VL CDR3 may be identical to the amino acid sequences of the VH CDR1, VH CDR2, VH CDR3, VL CDR1, VL CDR2, and VL CDR3, respectively, of an anti-CoV-S antibody selected from the group consisting of ADI-57983 (with primer mutation), ADI-57978 (with primer mutation), ADI-56868 (with primer mutation), ADI-56443 (with primer mutation), ADI-56479 (with primer mutation), ADI-58120, ADI-58121, ADI-58122, ADI-58123, ADI-58124, ADI-58125, ADI-58126, ADI-58127, ADI-58128, ADI-58129, ADI-58130, ADI-58131, ADI-58130_LCN30cQ, and ADI-59988.

In further preferred embodiments, the amino acid sequences of the VH CDR1, the VH CDR2, the VH CDR3, the VL CDR1, the VL CDR2, and the VL CDR3 may be identical to the amino acid sequences of the VH CDR1, VH CDR2, VH CDR3, VL CDR1, VL CDR2, and VL CDR3, respectively, of an anti-CoV-S antibody selected from the group consisting of ADI-57983 (with primer mutation), ADI-57978 (with primer mutation), ADI-56868 (with primer mutation), ADI-58120, ADI-58121, ADI-58122, ADI-58123, ADI-58124, ADI-58125, ADI-58126, ADI-58127, ADI-58128, ADI-58129, ADI-58130, ADI-58131, ADI-58130_LCN30cQ, and ADI-59988.

In certain embodiments, the isolated antibody or antigen-binding antibody fragment, optionally an affinity-matured variant of any of the anti-CoV-S antibodies disclosed herein, which specifically binds to CoV-S, may comprise: (a) a VH comprising a VH CDR1, VH CDR2, and VH CDR3; and (b) a VL comprising a VL CDR1, VL CDR2, and VL CDR3.

In some exemplary embodiments, the amino acid sequences of the VH CDR1, the VH CDR2, the VH CDR3, the VL CDR1, the VL CDR2, and the VL CDR3 may be identical to the amino acid sequences of:

(1) SEQ ID NOS: 104, 106, 108, 114, 116, and 118, respectively;
(2) SEQ ID NOS: 204, 206, 208, 214, 216, and 218, respectively;
(3) SEQ ID NOS: 304, 306, 308, 314, 316, and 318, respectively;
(4) SEQ ID NOS: 404, 406, 408, 414, 416, and 418, respectively;
(5) SEQ ID NOS: 504, 506, 508, 514, 516, and 518, respectively;
(6) SEQ ID NOS: 604, 606, 608, 614, 616, and 618, respectively;
(7) SEQ ID NOS: 704, 706, 708, 714, 716, and 718, respectively;
(8) SEQ ID NOS: 804, 806, 808, 814, 816, and 818, respectively;
(9) SEQ ID NOS: 904, 906, 908, 914, 916, and 918, respectively;
(10) SEQ ID NOS: 1004, 1006, 1008, 1014, 1016, and 1018, respectively;
(11) SEQ ID NOS: 1104, 1106, 1108, 1114, 1116, and 1118, respectively;
(12) SEQ ID NOS: 1204, 1206, 1208, 1214, 1216, and 1218, respectively;
(13) SEQ ID NOS: 1304, 1306, 1308, 1314, 1316, and 1318, respectively;
(14) SEQ ID NOS: 1404, 1406, 1408, 1414, 1416, and 1418, respectively;
(15) SEQ ID NOS: 1504, 1506, 1508, 1514, 1516, and 1518, respectively;
(16) SEQ ID NOS: 1604, 1606, 1608, 1614, 1616, and 1618, respectively;
(17) SEQ ID NOS: 1704, 1706, 1708, 1714, 1716, and 1718, respectively;
(18) SEQ ID NOS: 1804, 1806, 1808, 1814, 1816, and 1818, respectively;
(19) SEQ ID NOS: 1904, 1906, 1908, 1914, 1916, and 1918, respectively;
(20) SEQ ID NOS: 2004, 2006, 2008, 2014, 2016, and 2018, respectively;
(21) SEQ ID NOS: 2104, 2106, 2108, 2114, 2116, and 2118, respectively;
(22) SEQ ID NOS: 2204, 2206, 2208, 2214, 2216, and 2218, respectively;
(23) SEQ ID NOS: 2304, 2306, 2308, 2314, 2316, and 2318, respectively;
(24) SEQ ID NOS: 2404, 2406, 2408, 2414, 2416, and 2418, respectively;
(25) SEQ ID NOS: 2504, 2506, 2508, 2514, 2516, and 2518, respectively;
(26) SEQ ID NOS: 2604, 2606, 2608, 2614, 2616, and 2618, respectively;
(27) SEQ ID NOS: 2704, 2706, 2708, 2714, 2716, and 2718, respectively;
(28) SEQ ID NOS: 2804, 2806, 2808, 2814, 2816, and 2818, respectively;
(29) SEQ ID NOS: 2904, 2906, 2908, 2914, 2916, and 2918, respectively;
(30) SEQ ID NOS: 3004, 3006, 3008, 3014, 3016, and 3018, respectively;
(31) SEQ ID NOS: 3104, 3106, 3108, 3114, 3116, and 3118, respectively;
(32) SEQ ID NOS: 3204, 3206, 3208, 3214, 3216, and 3218, respectively;
(33) SEQ ID NOS: 3304, 3306, 3308, 3314, 3316, and 3318, respectively;
(34) SEQ ID NOS: 3404, 3406, 3408, 3414, 3416, and 3418, respectively;
(35) SEQ ID NOS: 3504, 3506, 3508, 3514, 3516, and 3518, respectively;
(36) SEQ ID NOS: 3604, 3606, 3608, 3614, 3616, and 3618, respectively;
(37) SEQ ID NOS: 3704, 3706, 3708, 3714, 3716, and 3718, respectively;
(38) SEQ ID NOS: 3804, 3806, 3808, 3814, 3816, and 3818, respectively;
(39) SEQ ID NOS: 3904, 3906, 3908, 3914, 3916, and 3918, respectively;
(40) SEQ ID NOS: 4004, 4006, 4008, 4014, 4016, and 4018, respectively;
(41) SEQ ID NOS: 4104, 4106, 4108, 4114, 4116, and 4118, respectively;
(42) SEQ ID NOS: 4204, 4206, 4208, 4214, 4216, and 4218, respectively;
(43) SEQ ID NOS: 4304, 4306, 4308, 4314, 4316, and 4318, respectively;
(44) SEQ ID NOS: 4404, 4406, 4408, 4414, 4416, and 4418, respectively;
(45) SEQ ID NOS: 4504, 4506, 4508, 4514, 4516, and 4518, respectively;
(46) SEQ ID NOS: 4604, 4606, 4608, 4614, 4616, and 4618, respectively;
(47) SEQ ID NOS: 4704, 4706, 4708, 4714, 4716, and 4718, respectively;
(48) SEQ ID NOS: 4804, 4806, 4808, 4814, 4816, and 4818, respectively;
(49) SEQ ID NOS: 4904, 4906, 4908, 4914, 4916, and 4918, respectively;
(50) SEQ ID NOS: 5004, 5006, 5008, 5014, 5016, and 5018, respectively;
(51) SEQ ID NOS: 5104, 5106, 5108, 5114, 5116, and 5118, respectively;
(52) SEQ ID NOS: 5204, 5206, 5208, 5214, 5216, and 5218, respectively;
(53) SEQ ID NOS: 5304, 5306, 5308, 5314, 5316, and 5318, respectively;
(54) SEQ ID NOS: 5404, 5406, 5408, 5414, 5416, and 5418, respectively;
(55) SEQ ID NOS: 5504, 5506, 5508, 5514, 5516, and 5518, respectively;
(56) SEQ ID NOS: 5604, 5606, 5608, 5614, 5616, and 5618, respectively;
(57) SEQ ID NOS: 5704, 5706, 5708, 5714, 5716, and 5718, respectively;
(58) SEQ ID NOS: 5804, 5806, 5808, 5814, 5816, and 5818, respectively;
(59) SEQ ID NOS: 5904, 5906, 5908, 5914, 5916, and 5918, respectively;
(60) SEQ ID NOS: 6004, 6006, 6008, 6014, 6016, and 6018, respectively;
(61) SEQ ID NOS: 6124, 6106, 6108, 6114, 6161, and 6118, respectively;
(62) SEQ ID NOS: 6204, 6206, 6208, 6214, 6216, and 6218, respectively;
(63) SEQ ID NOS: 6304, 6306, 6308, 6314, 6316, and 6318, respectively;
(64) SEQ ID NOS: 6404, 6406, 6408, 6414, 6416, and 6418, respectively;

(65) SEQ ID NOS: 6504, 6506, 6508, 6514, 6516, and 6518, respectively;
(66) SEQ ID NOS: 6604, 6606, 6608, 6614, 6616, and 6618, respectively;
(67) SEQ ID NOS: 6704, 6706, 6708, 6714, 6716, and 6718, respectively;
(68) SEQ ID NOS: 6804, 6806, 6808, 6814, 6816, and 6818, respectively;
(69) SEQ ID NOS: 6904, 6906, 6908, 6914, 6916, and 6918, respectively;
(70) SEQ ID NOS: 7004, 7006, 7008, 7014, 7016, and 7018, respectively;
(71) SEQ ID NOS: 7104, 7106, 7108, 7114, 7116, and 7118, respectively.
(72) SEQ ID NOS: 7204, 7206, 7208, 7214, 7216, and 7218, respectively;
(73) SEQ ID NOS: 7304, 7306, 7308, 7314, 7316, and 7318, respectively;
(74) SEQ ID NOS: 7404, 7406, 7408, 7414, 7416, and 7418, respectively;
(75) SEQ ID NOS: 7504, 7506, 7508, 7514, 7516, and 7518, respectively;
(76) SEQ ID NOS: 7604, 7606, 7608, 7614, 7616, and 7618, respectively;
(77) SEQ ID NOS: 7704, 7706, 7708, 7714, 7716, and 7718, respectively;
(78) SEQ ID NOS: 7804, 7806, 7808, 7814, 7816, and 7818, respectively;
(79) SEQ ID NOS: 7904, 7906, 7908, 7914, 7916, and 7918, respectively;
(80) SEQ ID NOS: 8004, 8006, 8008, 8014, 8016, and 8018, respectively;
(81) SEQ ID NOS: 8104, 8106, 8108, 8114, 8116, and 8118, respectively;
(82) SEQ ID NOS: 8204, 8206, 8208, 8214, 8216, and 8218, respectively;
(83) SEQ ID NOS: 8304, 8306, 8308, 8314, 8316, and 8318, respectively;
(84) SEQ ID NOS: 8404, 8406, 8408, 8414, 8416, and 8418, respectively;
(85) SEQ ID NOS: 8504, 8506, 8508, 8514, 8516, and 8518, respectively;
(86) SEQ ID NOS: 8604, 8606, 8608, 8614, 8616, and 8618, respectively;
(87) SEQ ID NOS: 8704, 8706, 8708, 8714, 8716, and 8718, respectively;
(88) SEQ ID NOS: 8804, 8806, 8808, 8814, 8816, and 8818, respectively;
(89) SEQ ID NOS: 8904, 8906, 8908, 8914, 8916, and 8918, respectively;
(90) SEQ ID NOS: 9004, 9006, 9008, 9014, 9016, and 9018, respectively;
(101) SEQ ID NOS: 10104, 10106, 10108, 10114, 10116, and 10118, respectively;
(102) SEQ ID NOS: 10204, 10206, 10208, 10214, 10216, and 10218, respectively;
(103) SEQ ID NOS: 10304, 10306, 10308, 10314, 10316, and 10318, respectively;
(104) SEQ ID NOS: 10404, 10406, 10408, 10414, 10416, and 10418, respectively;
(105) SEQ ID NOS: 10504, 10506, 10508, 10514, 10516, and 10518, respectively;
(106) SEQ ID NOS: 10604, 10606, 10608, 10614, 10616, and 10618, respectively;
(107) SEQ ID NOS: 10704, 10706, 10708, 10714, 10716, and 10718, respectively;
(108) SEQ ID NOS: 10804, 10806, 10808, 10814, 10816, and 10818, respectively;
(109) SEQ ID NOS: 10904, 10906, 10908, 10914, 10916, and 10918, respectively;
(110) SEQ ID NOS: 11004, 11006, 11008, 11014, 11016, and 11018, respectively;
(111) SEQ ID NOS: 11104, 11106, 11108, 11114, 11116, and 11118, respectively;
(112) SEQ ID NOS: 11204, 11206, 11208, 11214, 11216, and 11218, respectively;
(113) SEQ ID NOS: 11304, 11306, 11308, 11314, 11316, and 11318, respectively;
(114) SEQ ID NOS: 11404, 11406, 11408, 11414, 11416, and 11418, respectively;
(115) SEQ ID NOS: 11504, 11506, 11508, 11514, 11516, and 11518, respectively;
(116) SEQ ID NOS: 11604, 11606, 11608, 11614, 11616, and 11618, respectively;
(117) SEQ ID NOS: 11704, 11706, 11708, 11714, 11716, and 11718, respectively;
(118) SEQ ID NOS: 11804, 11806, 11808, 11814, 11816, and 11818, respectively;
(119) SEQ ID NOS: 11904, 11906, 11908, 11914, 11916, and 11918, respectively;
(120) SEQ ID NOS: 12004, 12006, 12008, 12014, 12016, and 12018, respectively;
(121) SEQ ID NOS: 12104, 12106, 12108, 12114, 12116, and 12118, respectively;
(122) SEQ ID NOS: 12204, 12206, 12208, 12214, 12216, and 12218, respectively;
(123) SEQ ID NOS: 12304, 12306, 12308, 12314, 12316, and 12318, respectively;
(124) SEQ ID NOS: 12404, 12406, 12408, 12414, 12416, and 12418, respectively;
(125) SEQ ID NOS: 12504, 12506, 12508, 12514, 12516, and 12518, respectively;
(126) SEQ ID NOS: 12604, 12606, 12608, 12614, 12616, and 12618, respectively;
(127) SEQ ID NOS: 12704, 12706, 12708, 12714, 12716, and 12718, respectively;
(128) SEQ ID NOS: 12804, 12806, 12808, 12814, 12816, and 12818, respectively;
(129) SEQ ID NOS: 12904, 12906, 12908, 12914, 12916, and 12918, respectively;
(130) SEQ ID NOS: 13004, 13006, 13008, 13014, 13016, and 13018, respectively;
(131) SEQ ID NOS: 13104, 13106, 13108, 13114, 13116, and 13118, respectively;
(132) SEQ ID NOS: 13204, 13206, 13208, 13214, 13216, and 13218, respectively;
(133) SEQ ID NOS: 13304, 13306, 13308, 13314, 13316, and 13318, respectively;
(134) SEQ ID NOS: 13404, 13406, 13408, 13414, 13416, and 13418, respectively;
(135) SEQ ID NOS: 13504, 13506, 13508, 13514, 13516, and 13518, respectively;
(136) SEQ ID NOS: 13604, 13606, 13608, 13614, 13616, and 13618, respectively;
(137) SEQ ID NOS: 13704, 13706, 13708, 13714, 13716, and 13718, respectively;
(138) SEQ ID NOS: 13804, 13806, 13808, 13814, 13816, and 13818, respectively;
(139) SEQ ID NOS: 13904, 13906, 13908, 13914, 13916, and 13918, respectively;
(140) SEQ ID NOS: 14004, 14006, 14008, 14014, 14016, and 14018, respectively;

(141) SEQ ID NOS: 14104, 14106, 14108, 14114, 14116, and 14118, respectively;
(142) SEQ ID NOS: 14204, 14206, 14208, 14214, 14216, and 14218, respectively;
(143) SEQ ID NOS: 14304, 14306, 14308, 14314, 14316, and 14318, respectively;
(144) SEQ ID NOS: 14404, 14406, 14408, 14414, 14416, and 14418, respectively;
(145) SEQ ID NOS: 14504, 14506, 14508, 14514, 14516, and 14518, respectively;
(146) SEQ ID NOS: 14604, 14606, 14608, 14614, 14616, and 14618, respectively;
(147) SEQ ID NOS: 14704, 14706, 14708, 14714, 14716, and 14718, respectively;
(148) SEQ ID NOS: 14804, 14806, 14808, 14814, 14816, and 14818, respectively;
(149) SEQ ID NOS: 14904, 14906, 14908, 14914, 14916, and 14918, respectively;
(150) SEQ ID NOS: 15004, 15006, 15008, 15014, 15016, and 15018, respectively;
(151) SEQ ID NOS: 15104, 15106, 15108, 15114, 15116, and 15118, respectively;
(152) SEQ ID NOS: 15204, 15206, 15208, 15214, 15216, and 15218, respectively;
(153) SEQ ID NOS: 15304, 15306, 15308, 15314, 15316, and 15318, respectively;
(154) SEQ ID NOS: 15404, 15406, 15408, 15414, 15416, and 15418, respectively;
(155) SEQ ID NOS: 15504, 15506, 15508, 15514, 15516, and 15518, respectively;
(156) SEQ ID NOS: 15604, 15606, 15608, 15614, 15616, and 15618, respectively;
(157) SEQ ID NOS: 15704, 15706, 15708, 15714, 15716, and 15718, respectively;
(158) SEQ ID NOS: 15804, 15806, 15808, 15814, 15816, and 15818, respectively;
(159) SEQ ID NOS: 15904, 15906, 15908, 15914, 15916, and 15918, respectively;
(160) SEQ ID NOS: 16004, 16006, 16008, 16014, 16016, and 16018, respectively;
(161) SEQ ID NOS: 16104, 16106, 16108, 16114, 16116, and 16118, respectively;
(162) SEQ ID NOS: 16204, 16206, 16208, 16214, 16216, and 16218, respectively;
(163) SEQ ID NOS: 16304, 16306, 16308, 16314, 16316, and 16318, respectively;
(164) SEQ ID NOS: 16404, 16406, 16408, 16414, 16416, and 16418, respectively;
(165) SEQ ID NOS: 16504, 16506, 16508, 16514, 16516, and 16518, respectively;
(166) SEQ ID NOS: 16604, 16606, 16608, 16614, 16616, and 16618, respectively;
(167) SEQ ID NOS: 16704, 16706, 16708, 16714, 16716, and 16718, respectively;
(168) SEQ ID NOS: 16804, 16806, 16808, 16814, 16816, and 16818, respectively;
(169) SEQ ID NOS: 16904, 16906, 16908, 16914, 16916, and 16918, respectively;
(170) SEQ ID NOS: 17004, 17006, 17008, 17014, 17016, and 17018, respectively;
(171) SEQ ID NOS: 17104, 17106, 17108, 17114, 17116, and 17118, respectively;
(172) SEQ ID NOS: 17204, 17206, 17208, 17214, 17216, and 17218, respectively;
(173) SEQ ID NOS: 17304, 17306, 17308, 17314, 17316, and 17318, respectively;
(174) SEQ ID NOS: 17404, 17406, 17408, 17414, 17416, and 17418, respectively;
(175) SEQ ID NOS: 17504, 17506, 17508, 17514, 17516, and 17518, respectively;
(176) SEQ ID NOS: 17604, 17606, 17608, 17614, 17616, and 17618, respectively;
(177) SEQ ID NOS: 17704, 17706, 17708, 17714, 17716, and 17718, respectively;
(178) SEQ ID NOS: 17804, 17806, 17808, 17814, 17816, and 17818, respectively;
(179) SEQ ID NOS: 17904, 17906, 17908, 17914, 17916, and 17918, respectively;
(180) SEQ ID NOS: 18004, 18006, 18008, 18014, 18016, and 18018, respectively;
(181) SEQ ID NOS: 18104, 18106, 18108, 18114, 18116, and 18118, respectively;
(182) SEQ ID NOS: 18204, 18206, 18208, 18214, 18216, and 18218, respectively;
(183) SEQ ID NOS: 18304, 18306, 18308, 18314, 18316, and 18318, respectively;
(184) SEQ ID NOS: 18404, 18406, 18408, 18414, 18416, and 18418, respectively;
(185) SEQ ID NOS: 18504, 18506, 18508, 18514, 18516, and 18518, respectively;
(186) SEQ ID NOS: 18604, 18606, 18608, 18614, 18616, and 18618, respectively;
(187) SEQ ID NOS: 18704, 18706, 18708, 18714, 18716, and 18718, respectively;
(188) SEQ ID NOS: 18804, 18806, 18808, 18814, 18816, and 18818, respectively;
(189) SEQ ID NOS: 18904, 18906, 18908, 18914, 18916, and 18918, respectively;
(190) SEQ ID NOS: 19004, 19006, 19008, 19014, 19016, and 19018, respectively;
(191) SEQ ID NOS: 19104, 19106, 19108, 19114, 19116, and 19118, respectively;
(192) SEQ ID NOS: 19204, 19206, 19208, 19214, 19216, and 19218, respectively;
(193) SEQ ID NOS: 19304, 19306, 19308, 19314, 19316, and 19318, respectively;
(194) SEQ ID NOS: 19404, 19406, 19408, 19414, 19416, and 19418, respectively;
(195) SEQ ID NOS: 19504, 19506, 19508, 19514, 19516, and 19518, respectively;
(196) SEQ ID NOS: 19604, 19606, 19608, 19614, 19616, and 19618, respectively;
(197) SEQ ID NOS: 19704, 19706, 19708, 19714, 19716, and 19718, respectively;
(198) SEQ ID NOS: 19804, 19806, 19808, 19814, 19816, and 19818, respectively;
(199) SEQ ID NOS: 19904, 19906, 19908, 19914, 19916, and 19918, respectively;
(200) SEQ ID NOS: 20004, 20006, 20008, 20014, 20016, and 20018, respectively;
(201) SEQ ID NOS: 20104, 20106, 20108, 20114, 20116, and 20118, respectively;
(202) SEQ ID NOS: 20204, 20206, 20208, 20214, 20216, and 20218, respectively;
(203) SEQ ID NOS: 20304, 20306, 20308, 20314, 20316, and 20318, respectively;
(204) SEQ ID NOS: 20404, 20406, 20408, 20414, 20416, and 20418, respectively;
(205) SEQ ID NOS: 20504, 20506, 20508, 20514, 20516, and 20518, respectively;
(206) SEQ ID NOS: 20604, 20606, 20608, 20614, 20616, and 20618, respectively;

(207) SEQ ID NOS: 20704, 20706, 20708, 20714, 20716, and 20718, respectively;
(208) SEQ ID NOS: 20804, 20806, 20808, 20814, 20816, and 20818, respectively;
(209) SEQ ID NOS: 20904, 20906, 20908, 20914, 20916, and 20918, respectively;
(210) SEQ ID NOS: 21004, 21006, 21008, 21014, 21016, and 21018, respectively;
(211) SEQ ID NOS: 21104, 21106, 21108, 21114, 21116, and 21118, respectively;
(212) SEQ ID NOS: 21204, 21206, 21208, 21214, 21216, and 21218, respectively;
(213) SEQ ID NOS: 21304, 21306, 21308, 21314, 21316, and 21318, respectively;
(214) SEQ ID NOS: 21404, 21406, 21408, 21414, 21416, and 21418, respectively;
(215) SEQ ID NOS: 21504, 21506, 21508, 21514, 21516, and 21518, respectively;
(216) SEQ ID NOS: 21604, 21606, 21608, 21614, 21616, and 21618, respectively;
(217) SEQ ID NOS: 21704, 21706, 21708, 21714, 21716, and 21718, respectively;
(218) SEQ ID NOS: 21804, 21806, 21808, 21814, 21816, and 21818, respectively;
(219) SEQ ID NOS: 21904, 21906, 21908, 21914, 21916, and 21918, respectively;
(220) SEQ ID NOS: 22004, 22006, 22008, 22014, 22016, and 22018, respectively;
(221) SEQ ID NOS: 22104, 22106, 22108, 22114, 22116, and 22118, respectively;
(222) SEQ ID NOS: 22204, 22206, 22208, 22214, 22216, and 22218, respectively;
(223) SEQ ID NOS: 22304, 22306, 22308, 22314, 22316, and 22318, respectively;
(224) SEQ ID NOS: 22404, 22406, 22408, 22414, 22416, and 22418, respectively;
(225) SEQ ID NOS: 22504, 22506, 22508, 22514, 22516, and 22518, respectively;
(226) SEQ ID NOS: 22604, 22606, 22608, 22614, 22616, and 22618, respectively;
(227) SEQ ID NOS: 22704, 22706, 22708, 22714, 22716, and 22718, respectively;
(228) SEQ ID NOS: 22804, 22806, 22808, 22814, 22816, and 22818, respectively;
(229) SEQ ID NOS: 22904, 22906, 22908, 22914, 22916, and 22918, respectively;
(230) SEQ ID NOS: 23004, 23006, 23008, 23014, 23016, and 23018, respectively; or
(231) SEQ ID NOS: 23104, 23106, 23108, 23114, 23116, and 23118, respectively.

In particular exemplary embodiments, the amino acid sequences of the VH CDR1, the VH CDR2, the VH CDR3, the VL CDR1, the VL CDR2, and the VL CDR3 may be identical to the amino acid sequences of:
(1) SEQ ID NOS: 104, 106, 108, 114, 116, and 118, respectively;
(2) SEQ ID NOS: 204, 206, 208, 214, 216, and 218, respectively;
(3) SEQ ID NOS: 304, 306, 308, 314, 316, and 318, respectively;
(86) SEQ ID NOS: 8604, 8606, 8608, 8614, 8616, and 8618, respectively;
(123) SEQ ID NOS: 12304, 12306, 12308, 12314, 12316, and 12318, respectively;
(130) SEQ ID NOS: 13004, 13006, 13008, 13014, 13016, and 13018, respectively;
(140) SEQ ID NOS: 14004, 14006, 14008, 14014, 14016, and 14018, respectively;
(162) SEQ ID NOS: 16204, 16206, 16208, 16214, 16216, and 16218, respectively;
(175) SEQ ID NOS: 17504, 17506, 17508, 17514, 17516, and 17518, respectively;
(212) SEQ ID NOS: 21204, 21206, 21208, 21214, 21216, and 21218, respectively;
(213) SEQ ID NOS: 21304, 21306, 21308, 21314, 21316, and 21318, respectively;
(214) SEQ ID NOS: 21404, 21406, 21408, 21414, 21416, and 21418, respectively;
(215) SEQ ID NOS: 21504, 21506, 21508, 21514, 21516, and 21518, respectively;
(216) SEQ ID NOS: 21604, 21606, 21608, 21614, 21616, and 21618, respectively;
(217) SEQ ID NOS: 21704, 21706, 21708, 21714, 21716, and 21718, respectively;
(218) SEQ ID NOS: 21804, 21806, 21808, 21814, 21816, and 21818, respectively;
(219) SEQ ID NOS: 21904, 21906, 21908, 21914, 21916, and 21918, respectively;
(220) SEQ ID NOS: 22004, 22006, 22008, 22014, 22016, and 22018, respectively;
(221) SEQ ID NOS: 22104, 22106, 22108, 22114, 22116, and 22118, respectively;
(222) SEQ ID NOS: 22204, 22206, 22208, 22214, 22216, and 22218, respectively;
(223) SEQ ID NOS: 22304, 22306, 22308, 22314, 22316, and 22318, respectively;
(224) SEQ ID NOS: 22404, 22406, 22408, 22414, 22416, and 22418, respectively;
(225) SEQ ID NOS: 22504, 22506, 22508, 22514, 22516, and 22518, respectively;
(226) SEQ ID NOS: 22604, 22606, 22608, 22614, 22616, and 22618, respectively; or
(227) SEQ ID NOS: 22704, 22706, 22708, 22714, 22716, and 22718, respectively;
(228) SEQ ID NOS: 22804, 22806, 22808, 22814, 22816, and 22818, respectively;
(229) SEQ ID NOS: 22904, 22906, 22908, 22914, 22916, and 22918, respectively;
(230) SEQ ID NOS: 23004, 23006, 23008, 23014, 23016, and 23018, respectively; or
(231) SEQ ID NOS: 23104, 23106, 23108, 23114, 23116, and 23118, respectively.

In further exemplary embodiments, the amino acid sequences of the VH CDR1, the VH CDR2, the VH CDR3, the VL CDR1, the VL CDR2, and the VL CDR3 may be identical to the amino acid sequences of:
(212) SEQ ID NOS: 21204, 21206, 21208, 21214, 21216, and 21218, respectively;
(213) SEQ ID NOS: 21304, 21306, 21308, 21314, 21316, and 21318, respectively;
(214) SEQ ID NOS: 21404, 21406, 21408, 21414, 21416, and 21418, respectively;
(215) SEQ ID NOS: 21504, 21506, 21508, 21514, 21516, and 21518, respectively; (216) SEQ ID NOS: 21604, 21606, 21608, 21614, 21616, and 21618, respectively; (217) SEQ ID NOS: 21704, 21706, 21708, 21714, 21716, and 21718, respectively; (218) SEQ ID NOS: 21804, 21806, 21808, 21814, 21816, and 21818, respectively; (219) SEQ ID NOS: 21904, 21906, 21908, 21914, 21916, and 21918, respectively; (220) SEQ ID NOS: 22004, 22006, 22008, 22014, 22016, and 22018, respectively; (221) SEQ ID NOS: 22104, 22106, 22108, 22114, 22116, and 22118, respectively; (222) SEQ ID NOS: 22204, 22206, 22208, 22214, 22216, and 22218, respectively; (223) SEQ ID NOS: 22304, 22306, 22308, 22314, 22316, and 22318, respectively; (224) SEQ ID NOS: 22404, 22406, 22408, 22414, 22416, and 22418, respectively; (225) SEQ ID NOS: 22504, 22506, 22508, 22514, 22516, and 22518, respectively; (226) SEQ ID NOS: 22604, 22606, 22608, 22614, 22616, and 22618, respectively; (227) SEQ ID NOS: 22704, 22706, 22708, 22714, 22716, and 22718, respectively; (228) SEQ ID NOS: 22804, 22806, 22808, 22814, 22816, and 22818, respectively; (229) SEQ ID NOS: 22904, 22906, 22908, 22914, 22916, and 22918, respectively; (230) SEQ ID NOS: 23004, 23006, 23008, 23014, 23016, and 23018, respectively; or (231) SEQ ID NOS: 23104, 23106, 23108, 23114, 23116, and 23118, respectively.

In other words, the amino acid sequences of the VH CDR1, the VH CDR2, the VH CDR3, the VL CDR1, the VL CDR2, and the VL CDR3 may be identical to the VH CDR1, the VH CDR2, the VH CDR3, the VL CDR1, the VL CDR2, and the VL CDR3 and VL amino acid sequences of any one of anti-CoV-S antibodies described herein and in FIGS. 1, 2 and 36.

In some preferred embodiments, the amino acid sequences of the VH CDR1, the VH CDR2, the VH CDR3, the VL CDR1, the VL CDR2, and the VL CDR3 may be identical to the VH CDR1, the VH CDR2, the VH CDR3, the VL CDR1, the VL CDR2, and the VL CDR3 and VL amino acid sequences of an antibody selected from the group consisting of ADI-55688, ADI-55689, ADI-55690, ADI-55951, ADI-55993, ADI-56000, ADI-56010, ADI-56032, ADI-56046, ADI-57983 (with primer mutation), ADI-57978 (with primer mutation), ADI-56868 (with primer mutation), ADI-56443 (with primer mutation), ADI-56479 (with primer mutation), ADI-58120, ADI-58121, ADI-58122, ADI-58123, ADI-58124, ADI-58125, ADI-58126, ADI-58127, ADI-58128, ADI-58129, ADI-58130, ADI-58131, ADI-58130_LCN30cQ, and ADI-59988.

In further preferred embodiments, the amino acid sequences of the VH CDR1, the VH CDR2, the VH CDR3, the VL CDR1, the VL CDR2, and the VL CDR3 may be identical to the VH CDR1, the VH CDR2, the VH CDR3, the VL CDR1, the VL CDR2, and the VL CDR3 and VL amino acid sequences of an antibody selected from the group consisting of ADI-57983 (with primer mutation), ADI-57978 (with primer mutation), ADI-56868 (with primer mutation), ADI-56443 (with primer mutation), ADI-56479 (with primer mutation), ADI-58120, ADI-58121, ADI-58122, ADI-58123, ADI-58124, ADI-58125, ADI-58126, ADI-58127, ADI-58128, ADI-58129, ADI-58130, ADI-58131, ADI-58130_LCN30cQ, and ADI-59988.

In some embodiments, the isolated antibody or antigen-binding antibody fragment, optionally an affinity-matured variant of any of the anti-CoV-S antibodies disclosed herein, may possess one of the following structural features:

(1) (a) the VH may comprise an amino acid sequence with at least 90, 91, 92, 93, 94, 95, 96, 97, 98, 99, or 100% sequence identity to the amino acid sequence of SEQ ID NO: 102, and (b) the VL may comprise an amino acid sequence with at least 90, 91, 92, 93, 94, 95, 96, 97, 98, 99, or 100% sequence identity to the amino acid sequence of SEQ ID NO: 112;

(2) (a) the VH may comprise an amino acid sequence with at least 90, 91, 92, 93, 94, 95, 96, 97, 98, 99, or 100% sequence identity to the amino acid sequence of SEQ ID NO: 202, and (b) the VL may comprise an amino acid sequence with at least 90, 91, 92, 93, 94, 95, 96, 97, 98, 99, or 100% sequence identity to the amino acid sequence of SEQ ID NO: 212;

(3) (a) the VH may comprise an amino acid sequence with at least 90, 91, 92, 93, 94, 95, 96, 97, 98, 99, or 100% sequence identity to the amino acid sequence of SEQ ID NO: 302, and (b) the VL may comprise an amino acid sequence with at least 90, 91, 92, 93, 94, 95, 96, 97, 98, 99, or 100% sequence identity to the amino acid sequence of SEQ ID NO: 312;

(4) (a) the VH may comprise an amino acid sequence with at least 90, 91, 92, 93, 94, 95, 96, 97, 98, 99, or 100% sequence identity to the amino acid sequence of SEQ ID NO: 402, and (b) the VL may comprise an amino acid sequence with at least 90, 91, 92, 93, 94, 95, 96, 97, 98, 99, or 100% sequence identity to the amino acid sequence of SEQ ID NO: 412;

(5) (a) the VH may comprise an amino acid sequence with at least 90, 91, 92, 93, 94, 95, 96, 97, 98, 99, or 100% sequence identity to the amino acid sequence of SEQ ID NO: 502, and (b) the VL may comprise an amino acid sequence with at least 90, 91, 92, 93, 94, 95, 96, 97, 98, 99, or 100% sequence identity to the amino acid sequence of SEQ ID NO: 512;

(6) (a) the VH may comprise an amino acid sequence with at least 90, 91, 92, 93, 94, 95, 96, 97, 98, 99, or 100% sequence identity to the amino acid sequence of SEQ ID NO: 602, and (b) the VL may comprise an amino acid sequence with at least 90, 91, 92, 93, 94, 95, 96, 97, 98, 99, or 100% sequence identity to the amino acid sequence of SEQ ID NO: 612;

(7) (a) the VH may comprise an amino acid sequence with at least 90, 91, 92, 93, 94, 95, 96, 97, 98, 99, or 100% sequence identity to the amino acid sequence of SEQ ID NO: 702, and (b) the VL may comprise an amino acid sequence with at least 90, 91, 92, 93, 94, 95, 96, 97, 98, 99, or 100% sequence identity to the amino acid sequence of SEQ ID NO: 712;

(8) (a) the VH may comprise an amino acid sequence with at least 90, 91, 92, 93, 94, 95, 96, 97, 98, 99, or 100% sequence identity to the amino acid sequence of SEQ ID NO: 802, and (b) the VL may comprise an amino acid sequence with at least 90, 91, 92, 93, 94, 95, 96, 97, 98, 99, or 100% sequence identity to the amino acid sequence of SEQ ID NO: 812;

(9) (a) the VH may comprise an amino acid sequence with at least 90, 91, 92, 93, 94, 95, 96, 97, 98, 99, or 100% sequence identity to the amino acid sequence of SEQ ID NO: 902, and (b) the VL may comprise an amino acid sequence with at least 90, 91, 92, 93, 94, 95, 96, 97, 98, 99, or 100% sequence identity to the amino acid sequence of SEQ ID NO: 912;

(10) (a) the VH may comprise an amino acid sequence with at least 90, 91, 92, 93, 94, 95, 96, 97, 98, 99, or 100% sequence identity to the amino acid sequence of SEQ ID NO: 1002, and (b) the VL may comprise an amino acid sequence with at least 90, 91, 92, 93, 94, 95, 96, 97, 98, 99, or 100% sequence identity to the amino acid sequence of SEQ ID NO: 1012;

(11) (a) the VH may comprise an amino acid sequence with at least 90, 91, 92, 93, 94, 95, 96, 97, 98, 99, or 100% sequence identity to the amino acid sequence of SEQ ID NO: 1102, and (b) the VL may comprise an amino acid sequence with at least 90, 91, 92, 93, 94, 95, 96, 97, 98, 99, or 100% sequence identity to the amino acid sequence of SEQ ID NO: 1112;

(12) (a) the VH may comprise an amino acid sequence with at least 90, 91, 92, 93, 94, 95, 96, 97, 98, 99, or 100% sequence identity to the amino acid sequence of SEQ ID NO: 1202, and (b) the VL may comprise an amino acid sequence with at least 90, 91, 92, 93, 94, 95, 96, 97, 98, 99, or 100% sequence identity to the amino acid sequence of SEQ ID NO: 1212;

(13) (a) the VH may comprise an amino acid sequence with at least 90, 91, 92, 93, 94, 95, 96, 97, 98, 99, or 100% sequence identity to the amino acid sequence of SEQ ID NO: 1302, and (b) the VL may comprise an amino acid sequence with at least 90, 91, 92, 93, 94, 95, 96, 97, 98, 99, or 100% sequence identity to the amino acid sequence of SEQ ID NO: 1312;

(14) (a) the VH may comprise an amino acid sequence with at least 90, 91, 92, 93, 94, 95, 96, 97, 98, 99, or 100% sequence identity to the amino acid sequence of SEQ ID NO: 1402, and (b) the VL may comprise an amino acid sequence with at least 90, 91, 92, 93, 94, 95, 96, 97, 98, 99, or 100% sequence identity to the amino acid sequence of SEQ ID NO: 1412;

(15) (a) the VH may comprise an amino acid sequence with at least 90, 91, 92, 93, 94, 95, 96, 97, 98, 99, or 100% sequence identity to the amino acid sequence of SEQ ID NO: 1502, and (b) the VL may comprise an amino acid sequence with at least 90, 91, 92, 93, 94, 95, 96, 97, 98, 99, or 100% sequence identity to the amino acid sequence of SEQ ID NO: 1512;

(16) (a) the VH may comprise an amino acid sequence with at least 90, 91, 92, 93, 94, 95, 96, 97, 98, 99, or 100% sequence identity to the amino acid sequence of SEQ ID NO: 1602, and (b) the VL may comprise an amino acid sequence with at least 90, 91, 92, 93, 94, 95, 96, 97, 98, 99, or 100% sequence identity to the amino acid sequence of SEQ ID NO: 1612;

(17) (a) the VH may comprise an amino acid sequence with at least 90, 91, 92, 93, 94, 95, 96, 97, 98, 99, or 100% sequence identity to the amino acid sequence of SEQ ID NO: 1702, and (b) the VL may comprise an amino acid sequence with at least 90, 91, 92, 93, 94, 95, 96, 97, 98, 99, or 100% sequence identity to the amino acid sequence of SEQ ID NO: 1712;

(18) (a) the VH may comprise an amino acid sequence with at least 90, 91, 92, 93, 94, 95, 96, 97, 98, 99, or 100% sequence identity to the amino acid sequence of SEQ ID NO: 1802, and (b) the VL may comprise an amino acid sequence with at least 90, 91, 92, 93, 94, 95, 96, 97, 98, 99, or 100% sequence identity to the amino acid sequence of SEQ ID NO: 1812;

(19) (a) the VH may comprise an amino acid sequence with at least 90, 91, 92, 93, 94, 95, 96, 97, 98, 99, or 100% sequence identity to the amino acid sequence of SEQ ID NO: 1902, and (b) the VL may comprise an amino acid sequence with at least 90, 91, 92, 93, 94, 95, 96, 97, 98, 99, or 100% sequence identity to the amino acid sequence of SEQ ID NO: 1912;

(20) (a) the VH may comprise an amino acid sequence with at least 90, 91, 92, 93, 94, 95, 96, 97, 98, 99, or 100% sequence identity to the amino acid sequence of SEQ ID NO: 2002, and (b) the VL may comprise an amino acid sequence with at least 90, 91, 92, 93, 94, 95, 96, 97, 98, 99, or 100% sequence identity to the amino acid sequence of SEQ ID NO: 2012;

(21) (a) the VH may comprise an amino acid sequence with at least 90, 91, 92, 93, 94, 95, 96, 97, 98, 99, or 100% sequence identity to the amino acid sequence of SEQ ID NO: 2102, and (b) the VL may comprise an amino acid sequence with at least 90, 91, 92, 93, 94, 95, 96, 97, 98, 99, or 100% sequence identity to the amino acid sequence of SEQ ID NO: 2112;

(22) (a) the VH may comprise an amino acid sequence with at least 90, 91, 92, 93, 94, 95, 96, 97, 98, 99, or 100% sequence identity to the amino acid sequence of SEQ ID NO: 2202, and (b) the VL may comprise an amino acid sequence with at least 90, 91, 92, 93, 94, 95, 96, 97, 98, 99, or 100% sequence identity to the amino acid sequence of SEQ ID NO: 2212;

(23) (a) the VH may comprise an amino acid sequence with at least 90, 91, 92, 93, 94, 95, 96, 97, 98, 99, or 100% sequence identity to the amino acid sequence of SEQ ID NO: 2302, and (b) the VL may comprise an amino acid sequence with at least 90, 91, 92, 93, 94, 95, 96, 97, 98, 99, or 100% sequence identity to the amino acid sequence of SEQ ID NO: 2312;

(24) (a) the VH may comprise an amino acid sequence with at least 90, 91, 92, 93, 94, 95, 96, 97, 98, 99, or 100% sequence identity to the amino acid sequence of SEQ ID NO: 2402, and (b) the VL may comprise an amino acid sequence with at least 90, 91, 92, 93, 94, 95, 96, 97, 98, 99, or 100% sequence identity to the amino acid sequence of SEQ ID NO: 2412;

(25) (a) the VH may comprise an amino acid sequence with at least 90, 91, 92, 93, 94, 95, 96, 97, 98, 99, or 100% sequence identity to the amino acid sequence of SEQ ID NO: 2502, and (b) the VL may comprise an amino acid sequence with at least 90, 91, 92, 93, 94, 95, 96, 97, 98, 99, or 100% sequence identity to the amino acid sequence of SEQ ID NO: 2512;

(26) (a) the VH may comprise an amino acid sequence with at least 90, 91, 92, 93, 94, 95, 96, 97, 98, 99, or 100% sequence identity to the amino acid sequence of SEQ ID NO: 2602, and (b) the VL may comprise an amino acid sequence with at least 90, 91, 92, 93, 94, 95, 96, 97, 98, 99, or 100% sequence identity to the amino acid sequence of SEQ ID NO: 2612;

(27) (a) the VH may comprise an amino acid sequence with at least 90, 91, 92, 93, 94, 95, 96, 97, 98, 99, or 100% sequence identity to the amino acid sequence of SEQ ID NO: 2702, and (b) the VL may comprise an amino acid sequence with at least 90, 91, 92, 93, 94, 95, 96, 97, 98, 99, or 100% sequence identity to the amino acid sequence of SEQ ID NO: 2712;

(28) (a) the VH may comprise an amino acid sequence with at least 90, 91, 92, 93, 94, 95, 96, 97, 98, 99, or 100% sequence identity to the amino acid sequence of SEQ ID NO: 2802, and (b) the VL may comprise an amino acid sequence with at least 90, 91, 92, 93, 94, 95, 96, 97, 98, 99, or 100% sequence identity to the amino acid sequence of SEQ ID NO: 2812;

(29) (a) the VH may comprise an amino acid sequence with at least 90, 91, 92, 93, 94, 95, 96, 97, 98, 99, or 100% sequence identity to the amino acid sequence of SEQ ID NO: 2902, and (b) the VL may comprise an amino acid sequence with at least 90, 91, 92, 93, 94, 95, 96, 97, 98, 99, or 100% sequence identity to the amino acid sequence of SEQ ID NO: 2912;

(30) (a) the VH may comprise an amino acid sequence with at least 90, 91, 92, 93, 94, 95, 96, 97, 98, 99, or 100% sequence identity to the amino acid sequence of SEQ ID NO: 3002, and (b) the VL may comprise an amino acid sequence with at least 90, 91, 92, 93, 94, 95, 96, 97, 98, 99, or 100% sequence identity to the amino acid sequence of SEQ ID NO: 3012;

(31) (a) the VH may comprise an amino acid sequence with at least 90, 91, 92, 93, 94, 95, 96, 97, 98, 99, or 100% sequence identity to the amino acid sequence of SEQ ID NO: 3102, and (b) the VL may comprise an amino acid sequence with at least 90, 91, 92, 93, 94, 95, 96, 97, 98, 99, or 100% sequence identity to the amino acid sequence of SEQ ID NO: 3112;

(32) (a) the VH may comprise an amino acid sequence with at least 90, 91, 92, 93, 94, 95, 96, 97, 98, 99, or 100% sequence identity to the amino acid sequence of SEQ ID NO: 3202, and (b) the VL may comprise an amino acid sequence with at least 90, 91, 92, 93, 94, 95, 96, 97, 98, 99, or 100% sequence identity to the amino acid sequence of SEQ ID NO: 3212;

(33) (a) the VH may comprise an amino acid sequence with at least 90, 91, 92, 93, 94, 95, 96, 97, 98, 99, or 100% sequence identity to the amino acid sequence of SEQ ID NO: 3302, and (b) the VL may comprise an amino acid sequence with at least 90, 91, 92, 93, 94, 95, 96, 97, 98, 99, or 100% sequence identity to the amino acid sequence of SEQ ID NO: 3312;

(34) (a) the VH may comprise an amino acid sequence with at least 90, 91, 92, 93, 94, 95, 96, 97, 98, 99, or 100% sequence identity to the amino acid sequence of SEQ ID NO: 3402, and (b) the VL may comprise an amino acid sequence with at least 90, 91, 92, 93, 94, 95, 96, 97, 98, 99, or 100% sequence identity to the amino acid sequence of SEQ ID NO: 3412;

(35) (a) the VH may comprise an amino acid sequence with at least 90, 91, 92, 93, 94, 95, 96, 97, 98, 99, or 100% sequence identity to the amino acid sequence of SEQ ID NO: 3502, and (b) the VL may comprise an amino acid sequence with at least 90, 91, 92, 93, 94, 95, 96, 97, 98, 99, or 100% sequence identity to the amino acid sequence of SEQ ID NO: 3512;

(36) (a) the VH may comprise an amino acid sequence with at least 90, 91, 92, 93, 94, 95, 96, 97, 98, 99, or 100% sequence identity to the amino acid sequence of SEQ ID NO: 3602, and (b) the VL may comprise an amino acid sequence with at least 90, 91, 92, 93, 94, 95, 96, 97, 98, 99, or 100% sequence identity to the amino acid sequence of SEQ ID NO: 3612;

(37) (a) the VH may comprise an amino acid sequence with at least 90, 91, 92, 93, 94, 95, 96, 97, 98, 99, or 100% sequence identity to the amino acid sequence of SEQ ID NO: 3702, and (b) the VL may comprise an amino acid sequence with at least 90, 91, 92, 93, 94, 95, 96, 97, 98, 99, or 100% sequence identity to the amino acid sequence of SEQ ID NO: 3712;

(38) (a) the VH may comprise an amino acid sequence with at least 90, 91, 92, 93, 94, 95, 96, 97, 98, 99, or 100% sequence identity to the amino acid sequence of SEQ ID NO: 3802, and (b) the VL may comprise an amino acid sequence with at least 90, 91, 92, 93, 94, 95, 96, 97, 98, 99, or 100% sequence identity to the amino acid sequence of SEQ ID NO: 3812;

(39) (a) the VH may comprise an amino acid sequence with at least 90, 91, 92, 93, 94, 95, 96, 97, 98, 99, or 100% sequence identity to the amino acid sequence of SEQ ID NO: 3902, and (b) the VL may comprise an amino acid sequence with at least 90, 91, 92, 93, 94, 95, 96, 97, 98, 99, or 100% sequence identity to the amino acid sequence of SEQ ID NO: 3912;

(40) (a) the VH may comprise an amino acid sequence with at least 90, 91, 92, 93, 94, 95, 96, 97, 98, 99, or 100% sequence identity to the amino acid sequence of SEQ ID NO: 4002, and (b) the VL may comprise an amino acid sequence with at least 90, 91, 92, 93, 94, 95, 96, 97, 98, 99, or 100% sequence identity to the amino acid sequence of SEQ ID NO: 4012;

(41) (a) the VH may comprise an amino acid sequence with at least 90, 91, 92, 93, 94, 95, 96, 97, 98, 99, or 100% sequence identity to the amino acid sequence of SEQ ID NO: 4102, and (b) the VL may comprise an amino acid sequence with at least 90, 91, 92, 93, 94, 95, 96, 97, 98, 99, or 100% sequence identity to the amino acid sequence of SEQ ID NO: 4112;

(42) (a) the VH may comprise an amino acid sequence with at least 90, 91, 92, 93, 94, 95, 96, 97, 98, 99, or 100% sequence identity to the amino acid sequence of SEQ ID NO: 4202, and (b) the VL may comprise an amino acid sequence with at least 90, 91, 92, 93, 94, 95, 96, 97, 98, 99, or 100% sequence identity to the amino acid sequence of SEQ ID NO: 4212;

(43) (a) the VH may comprise an amino acid sequence with at least 90, 91, 92, 93, 94, 95, 96, 97, 98, 99, or 100% sequence identity to the amino acid sequence of SEQ ID NO: 4302, and (b) the VL may comprise an amino acid sequence with at least 90, 91, 92, 93, 94, 95, 96, 97, 98, 99, or 100% sequence identity to the amino acid sequence of SEQ ID NO: 4312;

(44) (a) the VH may comprise an amino acid sequence with at least 90, 91, 92, 93, 94, 95, 96, 97, 98, 99, or 100% sequence identity to the amino acid sequence of SEQ ID NO: 4402, and (b) the VL may comprise an amino acid sequence with at least 90, 91, 92, 93, 94, 95, 96, 97, 98, 99, or 100% sequence identity to the amino acid sequence of SEQ ID NO:4412;

(45) (a) the VH may comprise an amino acid sequence with at least 90, 91, 92, 93, 94, 95, 96, 97, 98, 99, or 100% sequence identity to the amino acid sequence of SEQ ID NO: 4502, and (b) the VL may comprise an amino acid sequence with at least 90, 91, 92, 93, 94, 95, 96, 97, 98, 99, or 100% sequence identity to the amino acid sequence of SEQ ID NO: 4512;

(46) (a) the VH may comprise an amino acid sequence with at least 90, 91, 92, 93, 94, 95, 96, 97, 98, 99, or 100% sequence identity to the amino acid sequence of SEQ ID NO: 4602, and (b) the VL may comprise an amino acid sequence with at least 90, 91, 92, 93, 94, 95, 96, 97, 98, 99, or 100% sequence identity to the amino acid sequence of SEQ ID NO: 4612;

(47) (a) the VH may comprise an amino acid sequence with at least 90, 91, 92, 93, 94, 95, 96, 97, 98, 99, or 100% sequence identity to the amino acid sequence of SEQ ID NO: 4702, and (b) the VL may comprise an amino acid sequence with at least 90, 91, 92, 93, 94, 95, 96, 97, 98, 99, or 100% sequence identity to the amino acid sequence of SEQ ID NO: 4712;

(48) (a) the VH may comprise an amino acid sequence with at least 90, 91, 92, 93, 94, 95, 96, 97, 98, 99, or 100% sequence identity to the amino acid sequence of SEQ ID NO: 4802, and (b) the VL may comprise an amino acid sequence with at least 90, 91, 92, 93, 94, 95, 96, 97, 98, 99, or 100% sequence identity to the amino acid sequence of SEQ ID NO: 4812;

(49) (a) the VH may comprise an amino acid sequence with at least 90, 91, 92, 93, 94, 95, 96, 97, 98, 99, or 100% sequence identity to the amino acid sequence of SEQ ID NO: 4902, and (b) the VL may comprise an amino acid sequence with at least 90, 91, 92, 93, 94, 95, 96, 97, 98, 99, or 100% sequence identity to the amino acid sequence of SEQ ID NO: 4912;

(50) (a) the VH may comprise an amino acid sequence with at least 90, 91, 92, 93, 94, 95, 96, 97, 98, 99, or 100% sequence identity to the amino acid sequence of SEQ ID NO: 5002, and (b) the VL may comprise an amino acid sequence with at least 90, 91, 92, 93, 94, 95, 96, 97, 98, 99, or 100% sequence identity to the amino acid sequence of SEQ ID NO: 5012;

(51) (a) the VH may comprise an amino acid sequence with at least 90, 91, 92, 93, 94, 95, 96, 97, 98, 99, or 100% sequence identity to the amino acid sequence of SEQ ID NO: 5102, and (b) the VL may comprise an amino acid sequence with at least 90, 91, 92, 93, 94, 95, 96, 97, 98, 99, or 100% sequence identity to the amino acid sequence of SEQ ID NO: 5112;

(52) (a) the VH may comprise an amino acid sequence with at least 90, 91, 92, 93, 94, 95, 96, 97, 98, 99, or 100% sequence identity to the amino acid sequence of SEQ ID NO: 5202, and (b) the VL may comprise an amino acid sequence with at least 90, 91, 92, 93, 94, 95, 96, 97, 98, 99, or 100% sequence identity to the amino acid sequence of SEQ ID NO: 5212;

(53) (a) the VH may comprise an amino acid sequence with at least 90, 91, 92, 93, 94, 95, 96, 97, 98, 99, or 100% sequence identity to the amino acid sequence of SEQ ID NO: 5302, and (b) the VL may comprise an amino acid sequence with at least 90, 91, 92, 93, 94, 95, 96, 97, 98, 99, or 100% sequence identity to the amino acid sequence of SEQ ID NO: 5312;

(54) (a) the VH may comprise an amino acid sequence with at least 90, 91, 92, 93, 94, 95, 96, 97, 98, 99, or 100% sequence identity to the amino acid sequence of SEQ ID NO: 5402, and (b) the VL may comprise an amino acid sequence with at least 90, 91, 92, 93, 94, 95, 96, 97, 98, 99, or 100% sequence identity to the amino acid sequence of SEQ ID NO: 5412;

(55) (a) the VH may comprise an amino acid sequence with at least 90, 91, 92, 93, 94, 95, 96, 97, 98, 99, or 100% sequence identity to the amino acid sequence of SEQ ID NO: 5502, and (b) the VL may comprise an amino acid sequence with at least 90, 91, 92, 93, 94, 95, 96, 97, 98, 99, or 100% sequence identity to the amino acid sequence of SEQ ID NO: 5512;

(56) (a) the VH may comprise an amino acid sequence with at least 90, 91, 92, 93, 94, 95, 96, 97, 98, 99, or 100% sequence identity to the amino acid sequence of SEQ ID NO: 5602, and (b) the VL may comprise an amino acid sequence with at least 90, 91, 92, 93, 94, 95, 96, 97, 98, 99, or 100% sequence identity to the amino acid sequence of SEQ ID NO: 5612;

(57) (a) the VH may comprise an amino acid sequence with at least 90, 91, 92, 93, 94, 95, 96, 97, 98, 99, or 100% sequence identity to the amino acid sequence of SEQ ID NO: 5702, and (b) the VL may comprise an amino acid sequence with at least 90, 91, 92, 93, 94, 95, 96, 97, 98, 99, or 100% sequence identity to the amino acid sequence of SEQ ID NO: 5712;

(58) (a) the VH may comprise an amino acid sequence with at least 90, 91, 92, 93, 94, 95, 96, 97, 98, 99, or 100% sequence identity to the amino acid sequence of SEQ ID NO: 5802, and (b) the VL may comprise an amino acid sequence with at least 90, 91, 92, 93, 94, 95, 96, 97, 98, 99, or 100% sequence identity to the amino acid sequence of SEQ ID NO: 5812;

(59) (a) the VH may comprise an amino acid sequence with at least 90, 91, 92, 93, 94, 95, 96, 97, 98, 99, or 100% sequence identity to the amino acid sequence of SEQ ID NO: 5902, and (b) the VL may comprise an amino acid sequence with at least 90, 91, 92, 93, 94, 95, 96, 97, 98, 99, or 100% sequence identity to the amino acid sequence of SEQ ID NO: 5912;

(60) (a) the VH may comprise an amino acid sequence with at least 90, 91, 92, 93, 94, 95, 96, 97, 98, 99, or 100% sequence identity to the amino acid sequence of SEQ ID NO: 6002, and (b) the VL may comprise an amino acid sequence with at least 90, 91, 92, 93, 94, 95, 96, 97, 98, 99, or 100% sequence identity to the amino acid sequence of SEQ ID NO: 6012;

(61) (a) the VH may comprise an amino acid sequence with at least 90, 91, 92, 93, 94, 95, 96, 97, 98, 99, or 100% sequence identity to the amino acid sequence of SEQ ID NO: 6102, and (b) the VL may comprise an amino acid sequence with at least 90, 91, 92, 93, 94, 95, 96, 97, 98, 99, or 100% sequence identity to the amino acid sequence of SEQ ID NO: 6112;

(62) (a) the VH may comprise an amino acid sequence with at least 90, 91, 92, 93, 94, 95, 96, 97, 98, 99, or 100% sequence identity to the amino acid sequence of SEQ ID NO: 6202, and (b) the VL may comprise an amino acid sequence with at least 90, 91, 92, 93, 94, 95, 96, 97, 98, 99, or 100% sequence identity to the amino acid sequence of SEQ ID NO: 6212;

(63) (a) the VH may comprise an amino acid sequence with at least 90, 91, 92, 93, 94, 95, 96, 97, 98, 99, or 100% sequence identity to the amino acid sequence of SEQ ID NO: 6302, and (b) the VL may comprise an amino acid sequence with at least 90, 91, 92, 93, 94, 95, 96, 97, 98, 99, or 100% sequence identity to the amino acid sequence of SEQ ID NO: 6312;

(64) (a) the VH may comprise an amino acid sequence with at least 90, 91, 92, 93, 94, 95, 96, 97, 98, 99, or 100% sequence identity to the amino acid sequence of SEQ ID NO: 6402, and (b) the VL may comprise an amino acid sequence with at least 90, 91, 92, 93, 94, 95, 96, 97, 98, 99, or 100% sequence identity to the amino acid sequence of SEQ ID NO: 6412;

(65) (a) the VH may comprise an amino acid sequence with at least 90, 91, 92, 93, 94, 95, 96, 97, 98, 99, or 100% sequence identity to the amino acid sequence of SEQ ID NO: 6502, and (b) the VL may comprise an amino acid sequence with at least 90, 91, 92, 93, 94, 95, 96, 97, 98, 99, or 100% sequence identity to the amino acid sequence of SEQ ID NO: 6512;

(66) (a) the VH may comprise an amino acid sequence with at least 90, 91, 92, 93, 94, 95, 96, 97, 98, 99, or 100% sequence identity to the amino acid sequence of SEQ ID NO: 6602, and (b) the VL may comprise an amino acid sequence with at least 90, 91, 92, 93, 94, 95, 96, 97, 98, 99, or 100% sequence identity to the amino acid sequence of SEQ ID NO: 6612;

(67) (a) the VH may comprise an amino acid sequence with at least 90, 91, 92, 93, 94, 95, 96, 97, 98, 99, or 100% sequence identity to the amino acid sequence of SEQ ID NO: 6702, and (b) the VL may comprise an amino acid sequence with at least 90, 91, 92, 93, 94, 95, 96, 97, 98, 99, or 100% sequence identity to the amino acid sequence of SEQ ID NO: 6712;

(68) (a) the VH may comprise an amino acid sequence with at least 90, 91, 92, 93, 94, 95, 96, 97, 98, 99, or 100% sequence identity to the amino acid sequence of SEQ ID NO: 6802, and (b) the VL may comprise an amino acid sequence with at least 90, 91, 92, 93, 94, 95, 96, 97, 98, 99, or 100% sequence identity to the amino acid sequence of SEQ ID NO: 6812;

(69) (a) the VH may comprise an amino acid sequence with at least 90, 91, 92, 93, 94, 95, 96, 97, 98, 99, or 100% sequence identity to the amino acid sequence of SEQ ID NO: 6902, and (b) the VL may comprise an amino acid sequence with at least 90, 91, 92, 93, 94, 95, 96, 97, 98, 99, or 100% sequence identity to the amino acid sequence of SEQ ID NO: 6912;

(70) (a) the VH may comprise an amino acid sequence with at least 90, 91, 92, 93, 94, 95, 96, 97, 98, 99, or 100% sequence identity to the amino acid sequence of SEQ ID NO: 7002, and (b) the VL may comprise an amino acid sequence with at least 90, 91, 92, 93, 94, 95, 96, 97, 98, 99, or 100% sequence identity to the amino acid sequence of SEQ ID NO: 7012;

(71) (a) the VH may comprise an amino acid sequence with at least 90, 91, 92, 93, 94, 95, 96, 97, 98, 99, or 100% sequence identity to the amino acid sequence of SEQ ID NO: 7102, and (b) the VL may comprise an amino acid sequence with at least 90, 91, 92, 93, 94, 95, 96, 97, 98, 99, or 100% sequence identity to the amino acid sequence of SEQ ID NO: 7112;

(72) (a) the VH may comprise an amino acid sequence with at least 90, 91, 92, 93, 94, 95, 96, 97, 98, 99, or 100% sequence identity to the amino acid sequence of SEQ ID NO: 7202, and (b) the VL comprise an amino acid sequence with at least 90, 91, 92, 93, 94, 95, 96, 97, 98, 99, or 100% sequence identity to the amino acid sequence of SEQ ID NO: 7212;

(73) (a) the VH may comprise an amino acid sequence with at least 90, 91, 92, 93, 94, 95, 96, 97, 98, 99, or 100% sequence identity to the amino acid sequence of SEQ ID NO: 7302, and (b) the VL may comprise an amino acid sequence with at least 90, 91, 92, 93, 94, 95, 96, 97, 98, 99, or 100% sequence identity to the amino acid sequence of SEQ ID NO: 7312;

(74) (a) the VH may comprise an amino acid sequence with at least 90, 91, 92, 93, 94, 95, 96, 97, 98, 99, or 100% sequence identity to the amino acid sequence of SEQ ID NO: 7402, and (b) the VL may comprise an amino acid sequence with at least 90, 91, 92, 93, 94, 95, 96, 97, 98, 99, or 100% sequence identity to the amino acid sequence of SEQ ID NO: 7412;

(75) (a) the VH may comprise an amino acid sequence with at least 90, 91, 92, 93, 94, 95, 96, 97, 98, 99, or 100% sequence identity to the amino acid sequence of SEQ ID NO: 7502, and (b) the VL may comprise an amino acid sequence with at least 90, 91, 92, 93, 94, 95, 96, 97, 98, 99, or 100% sequence identity to the amino acid sequence of SEQ ID NO: 7512;

(76) (a) the VH may comprise an amino acid sequence with at least 90, 91, 92, 93, 94, 95, 96, 97, 98, 99, or 100% sequence identity to the amino acid sequence of SEQ ID NO: 7602, and (b) the VL comprise an amino acid sequence with at least 90, 91, 92, 93, 94, 95, 96, 97, 98, 99, or 100% sequence identity to the amino acid sequence of SEQ ID NO: 7612;

(77) (a) the VH may comprise an amino acid sequence with at least 90, 91, 92, 93, 94, 95, 96, 97, 98, 99, or 100% sequence identity to the amino acid sequence of SEQ ID NO: 7702, and (b) the VL may comprise an amino acid sequence with at least 90, 91, 92, 93, 94, 95, 96, 97, 98, 99, or 100% sequence identity to the amino acid sequence of SEQ ID NO: 7712;

(78) (a) the VH may comprise an amino acid sequence with at least 90, 91, 92, 93, 94, 95, 96, 97, 98, 99, or 100% sequence identity to the amino acid sequence of SEQ ID NO: 7802, and (b) the VL may comprise an amino acid sequence with at least 90, 91, 92, 93, 94, 95, 96, 97, 98, 99, or 100% sequence identity to the amino acid sequence of SEQ ID NO: 7812;

(79) (a) the VH may comprise an amino acid sequence with at least 90, 91, 92, 93, 94, 95, 96, 97, 98, 99, or 100% sequence identity to the amino acid sequence of SEQ ID NO: 7902, and (b) the VL may comprise an amino acid sequence with at least 90, 91, 92, 93, 94, 95, 96, 97, 98, 99, or 100% sequence identity to the amino acid sequence of SEQ ID NO: 7912;

(80) (a) the VH may comprise an amino acid sequence with at least 90, 91, 92, 93, 94, 95, 96, 97, 98, 99, or 100% sequence identity to the amino acid sequence of SEQ ID NO: 8002, and (b) the VL may comprise an amino acid sequence with at least 90, 91, 92, 93, 94, 95, 96, 97, 98, 99, or 100% sequence identity to the amino acid sequence of SEQ ID NO: 8012;

(81) (a) the VH may comprise an amino acid sequence with at least 90, 91, 92, 93, 94, 95, 96, 97, 98, 99, or 100% sequence identity to the amino acid sequence of SEQ ID NO: 8102, and (b) the VL may comprise an amino acid sequence with at least 90, 91, 92, 93, 94, 95, 96, 97, 98, 99, or 100% sequence identity to the amino acid sequence of SEQ ID NO: 8112;

(82) (a) the VH may comprise an amino acid sequence with at least 90, 91, 92, 93, 94, 95, 96, 97, 98, 99, or 100% sequence identity to the amino acid sequence of SEQ ID NO: 8202, and (b) the VL may comprise an amino acid sequence with at least 90, 91, 92, 93, 94, 95, 96, 97, 98, 99, or 100% sequence identity to the amino acid sequence of SEQ ID NO: 8212;

(83) (a) the VH may comprise an amino acid sequence with at least 90, 91, 92, 93, 94, 95, 96, 97, 98, 99, or 100% sequence identity to the amino acid sequence of SEQ ID NO: 8302, and (b) the VL may comprise an amino acid sequence with at least 90, 91, 92, 93, 94, 95, 96, 97, 98, 99, or 100% sequence identity to the amino acid sequence of SEQ ID NO: 8312;

(84) (a) the VH may comprise an amino acid sequence with at least 90, 91, 92, 93, 94, 95, 96, 97, 98, 99, or 100% sequence identity to the amino acid sequence of SEQ ID NO: 8402, and (b) the VL nay comprise an amino acid sequence with at least 90, 91, 92, 93, 94, 95, 96, 97, 98, 99, or 100% sequence identity to the amino acid sequence of SEQ ID NO: 8412;

(85) (a) the VH may comprise an amino acid sequence with at least 90, 91, 92, 93, 94, 95, 96, 97, 98, 99, or 100% sequence identity to the amino acid sequence of SEQ ID NO: 8502, and (b) the VL may comprise an amino acid sequence with at least 90, 91, 92, 93, 94, 95, 96, 97, 98, 99, or 100% sequence identity to the amino acid sequence of SEQ ID NO: 8512;

(86) (a) the VH may comprise an amino acid sequence with at least 90, 91, 92, 93, 94, 95, 96, 97, 98, 99, or 100% sequence identity to the amino acid sequence of SEQ ID NO: 8602, and (b) the VL may comprise an amino acid sequence with at least 90, 91, 92, 93, 94, 95, 96, 97, 98, 99, or 100% sequence identity to the amino acid sequence of SEQ ID NO: 8612;

(87) (a) the VH may comprise an amino acid sequence with at least 90, 91, 92, 93, 94, 95, 96, 97, 98, 99, or 100% sequence identity to the amino acid sequence of SEQ ID NO: 8702, and (b) the VL may comprise an amino acid sequence with at least 90, 91, 92, 93, 94, 95, 96, 97, 98, 99, or 100% sequence identity to the amino acid sequence of SEQ ID NO: 8712;

(88) (a) the VH may comprise an amino acid sequence with at least 90, 91, 92, 93, 94, 95, 96, 97, 98, 99, or 100% sequence identity to the amino acid sequence of SEQ ID NO: 8802, and (b) the VL may comprise an amino acid sequence with at least 90, 91, 92, 93, 94, 95, 96, 97, 98, 99, or 100% sequence identity to the amino acid sequence of SEQ ID NO: 8812;

(89) (a) the VH may comprise an amino acid sequence with at least 90, 91, 92, 93, 94, 95, 96, 97, 98, 99, or 100% sequence identity to the amino acid sequence of SEQ ID NO: 8902, and (b) the VL may comprise an amino acid sequence with at least 90, 91, 92, 93, 94, 95, 96, 97, 98, 99, or 100% sequence identity to the amino acid sequence of SEQ ID NO: 8912;

(90) (a) the VH may comprise an amino acid sequence with at least 90, 91, 92, 93, 94, 95, 96, 97, 98, 99, or 100% sequence identity to the amino acid sequence of SEQ ID NO: 9002, and (b) the VL may comprise an amino acid sequence with at least 90, 91, 92, 93, 94, 95, 96, 97, 98, 99, or 100% sequence identity to the amino acid sequence of SEQ ID NO: 9012;

(91) (a) the VH may comprises an amino acid sequence with at least 90, 91, 92, 93, 94, 95, 96, 97, 98, 99, or 100% sequence identity to the amino acid sequence of SEQ ID NO: 9102, and (b) the VL may comprise an amino acid sequence with at least 90, 91, 92, 93, 94, 95, 96, 97, 98, 99, or 100% sequence identity to the amino acid sequence of SEQ ID NO: 9112;

(92) (a) the VH may comprises an amino acid sequence with at least 90, 91, 92, 93, 94, 95, 96, 97, 98, 99, or 100% sequence identity to the amino acid sequence of SEQ ID NO: 9202, and (b) the VL may comprise an amino acid sequence with at least 90, 91, 92, 93, 94, 95, 96, 97, 98, 99, or 100% sequence identity to the amino acid sequence of SEQ ID NO: 9212;

(93) (a) the VH may comprise an amino acid sequence with at least 90, 91, 92, 93, 94, 95, 96, 97, 98, 99, or 100% sequence identity to the amino acid sequence of SEQ ID NO: 9302, and (b) the VL may comprise an amino acid sequence with at least 90, 91, 92, 93, 94, 95, 96, 97, 98, 99, or 100% sequence identity to the amino acid sequence of SEQ ID NO: 9312;

(94) (a) the VH may comprise an amino acid sequence with at least 90, 91, 92, 93, 94, 95, 96, 97, 98, 99, or 100% sequence identity to the amino acid sequence of SEQ ID NO: 9402, and (b) the VL may comprise an amino acid sequence with at least 90, 91, 92, 93, 94, 95, 96, 97, 98, 99, or 100% sequence identity to the amino acid sequence of SEQ ID NO: 9412;

(95) (a) the VH may comprise an amino acid sequence with at least 90, 91, 92, 93, 94, 95, 96, 97, 98, 99, or 100% sequence identity to the amino acid sequence of SEQ ID NO: 9502, and (b) the VL may comprise an amino acid sequence with at least 90, 91, 92, 93, 94, 95, 96, 97, 98, 99, or 100% sequence identity to the amino acid sequence of SEQ ID NO: 9512;

(96) (a) the VH may comprise an amino acid sequence with at least 90, 91, 92, 93, 94, 95, 96, 97, 98, 99, or 100% sequence identity to the amino acid sequence of SEQ ID NO: 9602, and (b) the VL may comprise an amino acid sequence with at least 90, 91, 92, 93, 94, 95, 96, 97, 98, 99, or 100% sequence identity to the amino acid sequence of SEQ ID NO: 9612;

(97) (a) the VH may comprise an amino acid sequence with at least 90, 91, 92, 93, 94, 95, 96, 97, 98, 99, or 100% sequence identity to the amino acid sequence of SEQ ID NO: 9702, and (b) the VL may comprise an amino acid sequence with at least 90, 91, 92, 93, 94, 95, 96, 97, 98, 99, or 100% sequence identity to the amino acid sequence of SEQ ID NO: 9712;

(98) (a) the VH may comprise an amino acid sequence with at least 90, 91, 92, 93, 94, 95, 96, 97, 98, 99, or 100% sequence identity to the amino acid sequence of SEQ ID NO: 9802, and (b) the VL may comprise an amino acid sequence with at least 90, 91, 92, 93, 94, 95, 96, 97, 98, 99, or 100% sequence identity to the amino acid sequence of SEQ ID NO: 9812;

(99) (a) the VH may comprise an amino acid sequence with at least 90, 91, 92, 93, 94, 95, 96, 97, 98, 99, or 100% sequence identity to the amino acid sequence of SEQ ID NO: 9902, and (b) the VL may comprise an amino acid sequence with at least 90, 91, 92, 93, 94, 95, 96, 97, 98, 99, or 100% sequence identity to the amino acid sequence of SEQ ID NO: 9912;

(100) (a) the VH may comprise an amino acid sequence with at least 90, 91, 92, 93, 94, 95, 96, 97, 98, 99, or 100% sequence identity to the amino acid sequence of SEQ ID NO: 10002, and (b) the VL may comprise an amino acid sequence with at least 90, 91, 92, 93, 94, 95, 96, 97, 98, 99, or 100% sequence identity to the amino acid sequence of SEQ ID NO: 10012;

(101) (a) the VH may comprise an amino acid sequence with at least 90, 91, 92, 93, 94, 95, 96, 97, 98, 99, or 100% sequence identity to the amino acid sequence of SEQ ID NO: 10102, and (b) the VL may comprise an amino acid sequence with at least 90, 91, 92, 93, 94, 95, 96, 97, 98, 99, or 100% sequence identity to the amino acid sequence of SEQ ID NO: 10112;

(102) (a) the VH may comprise an amino acid sequence with at least 90, 91, 92, 93, 94, 95, 96, 97, 98, 99, or 100% sequence identity to the amino acid sequence of SEQ ID NO: 10202, and (b) the VL may comprise an amino acid sequence with at least 90, 91, 92, 93, 94, 95, 96, 97, 98, 99, or 100% sequence identity to the amino acid sequence of SEQ ID NO: 10212;

(103) (a) the VH may comprise an amino acid sequence with at least 90, 91, 92, 93, 94, 95, 96, 97, 98, 99, or 100% sequence identity to the amino acid sequence of SEQ ID NO: 10302, and (b) the VL may comprise an amino acid sequence with at least 90, 91, 92, 93, 94, 95, 96, 97, 98, 99, or 100% sequence identity to the amino acid sequence of SEQ ID NO: 10312;

(104) (a) the VH may comprise an amino acid sequence with at least 90, 91, 92, 93, 94, 95, 96, 97, 98, 99, or 100% sequence identity to the amino acid sequence of SEQ ID NO: 10402, and (b) the VL may comprise an amino acid sequence with at least 90, 91, 92, 93, 94, 95, 96, 97, 98, 99, or 100% sequence identity to the amino acid sequence of SEQ ID NO: 10412;

(105) (a) the VH may comprise an amino acid sequence with at least 90, 91, 92, 93, 94, 95, 96, 97, 98, 99, or 100% sequence identity to the amino acid sequence of SEQ ID NO: 10502, and (b) the VL may comprise an amino acid sequence with at least 90, 91, 92, 93, 94, 95, 96, 97, 98, 99, or 100% sequence identity to the amino acid sequence of SEQ ID NO: 10512;

(106) (a) the VH may comprise an amino acid sequence with at least 90, 91, 92, 93, 94, 95, 96, 97, 98, 99, or 100% sequence identity to the amino acid sequence of SEQ ID NO: 10602, and (b) the VL may comprise an amino acid sequence with at least 90, 91, 92, 93, 94, 95, 96, 97, 98, 99, or 100% sequence identity to the amino acid sequence of SEQ ID NO: 10612;

(107) (a) the VH may comprise an amino acid sequence with at least 90, 91, 92, 93, 94, 95, 96, 97, 98, 99, or 100% sequence identity to the amino acid sequence of SEQ ID NO: 10702, and (b) the VL may comprise an amino acid sequence with at least 90, 91, 92, 93, 94, 95, 96, 97, 98, 99, or 100% sequence identity to the amino acid sequence of SEQ ID NO: 10712;

(108) (a) the VH may comprise an amino acid sequence with at least 90, 91, 92, 93, 94, 95, 96, 97, 98, 99, or 100% sequence identity to the amino acid sequence of SEQ ID NO: 10802, and (b) the VL may comprise an amino acid sequence with at least 90, 91, 92, 93, 94, 95, 96, 97, 98, 99, or 100% sequence identity to the amino acid sequence of SEQ ID NO: 10812;

(109) (a) the VH may comprise an amino acid sequence with at least 90, 91, 92, 93, 94, 95, 96, 97, 98, 99, or 100% sequence identity to the amino acid sequence of SEQ ID NO: 10902, and (b) the VL may comprise an amino acid sequence with at least 90, 91, 92, 93, 94, 95, 96, 97, 98, 99, or 100% sequence identity to the amino acid sequence of SEQ ID NO: 10912;

(110) (a) the VH may comprise an amino acid sequence with at least 90, 91, 92, 93, 94, 95, 96, 97, 98, 99, or 100% sequence identity to the amino acid sequence of SEQ ID NO: 11002, and (b) the VL may comprise an amino acid sequence with at least 90, 91, 92, 93, 94, 95, 96, 97, 98, 99, or 100% sequence identity to the amino acid sequence of SEQ ID NO: 11012;

(111) (a) the VH may comprise an amino acid sequence with at least 90, 91, 92, 93, 94, 95, 96, 97, 98, 99, or 100% sequence identity to the amino acid sequence of SEQ ID NO: 11102, and (b) the VL may comprise an amino acid sequence with at least 90, 91, 92, 93, 94, 95, 96, 97, 98, 99, or 100% sequence identity to the amino acid sequence of SEQ ID NO: 11112;

(112) (a) the VH may comprise an amino acid sequence with at least 90, 91, 92, 93, 94, 95, 96, 97, 98, 99, or 100% sequence identity to the amino acid sequence of SEQ ID NO: 11202, and (b) the VL may comprise an amino acid sequence with at least 90, 91, 92, 93, 94, 95, 96, 97, 98, 99, or 100% sequence identity to the amino acid sequence of SEQ ID NO: 11212;

(113) (a) the VH may comprise an amino acid sequence with at least 90, 91, 92, 93, 94, 95, 96, 97, 98, 99, or 100% sequence identity to the amino acid sequence of SEQ ID NO: 11302, and (b) the VL may comprise an amino acid sequence with at least 90, 91, 92, 93, 94, 95, 96, 97, 98, 99, or 100% sequence identity to the amino acid sequence of SEQ ID NO: 11312;

(114) (a) the VH may comprise an amino acid sequence with at least 90, 91, 92, 93, 94, 95, 96, 97, 98, 99, or 100% sequence identity to the amino acid sequence of SEQ ID NO: 11402, and (b) the VL may comprise an amino acid sequence with at least 90, 91, 92, 93, 94, 95, 96, 97, 98, 99, or 100% sequence identity to the amino acid sequence of SEQ ID NO: 11412;

(115) (a) the VH may comprise an amino acid sequence with at least 90, 91, 92, 93, 94, 95, 96, 97, 98, 99, or 100% sequence identity to the amino acid sequence of SEQ ID NO: 11502, and (b) the VL may comprise an amino acid sequence with at least 90, 91, 92, 93, 94, 95, 96, 97, 98, 99, or 100% sequence identity to the amino acid sequence of SEQ ID NO: 11512;

(116) (a) the VH may comprise an amino acid sequence with at least 90, 91, 92, 93, 94, 95, 96, 97, 98, 99, or 100% sequence identity to the amino acid sequence of SEQ ID NO: 11602, and (b) the VL may comprise an amino acid sequence with at least 90, 91, 92, 93, 94, 95, 96, 97, 98, 99, or 100% sequence identity to the amino acid sequence of SEQ ID NO: 11612;

(117) (a) the VH may comprise an amino acid sequence with at least 90, 91, 92, 93, 94, 95, 96, 97, 98, 99, or 100% sequence identity to the amino acid sequence of SEQ ID NO: 11702, and (b) the VL may comprise an amino acid sequence with at least 90, 91, 92, 93, 94, 95, 96, 97, 98, 99, or 100% sequence identity to the amino acid sequence of SEQ ID NO: 11712;

(118) (a) the VH may comprise an amino acid sequence with at least 90, 91, 92, 93, 94, 95, 96, 97, 98, 99, or 100% sequence identity to the amino acid sequence of SEQ ID NO: 11802, and (b) the VL may comprise an amino acid sequence with at least 90, 91, 92, 93, 94, 95, 96, 97, 98, 99, or 100% sequence identity to the amino acid sequence of SEQ ID NO: 11812;

(119) (a) the VH may comprise an amino acid sequence with at least 90, 91, 92, 93, 94, 95, 96, 97, 98, 99, or 100% sequence identity to the amino acid sequence of SEQ ID NO: 11902, and (b) the VL may comprise an amino acid sequence with at least 90, 91, 92, 93, 94, 95, 96, 97, 98, 99, or 100% sequence identity to the amino acid sequence of SEQ ID NO: 11912;

(120) (a) the VH may comprise an amino acid sequence with at least 90, 91, 92, 93, 94, 95, 96, 97, 98, 99, or 100% sequence identity to the amino acid sequence of SEQ ID NO: 12002, and (b) the VL may comprise an amino acid sequence with at least 90, 91, 92, 93, 94, 95, 96, 97, 98, 99, or 100% sequence identity to the amino acid sequence of SEQ ID NO: 12012;

(121) (a) the VH may comprise an amino acid sequence with at least 90, 91, 92, 93, 94, 95, 96, 97, 98, 99, or 100% sequence identity to the amino acid sequence of SEQ ID NO: 12102, and (b) the VL may comprise an amino acid sequence with at least 90, 91, 92, 93, 94, 95, 96, 97, 98, 99, or 100% sequence identity to the amino acid sequence of SEQ ID NO: 12112;

(122) (a) the VH may comprise an amino acid sequence with at least 90, 91, 92, 93, 94, 95, 96, 97, 98, 99, or 100% sequence identity to the amino acid sequence of SEQ ID NO: 12202, and (b) the VL may comprise an amino acid sequence with at least 90, 91, 92, 93, 94, 95, 96, 97, 98, 99, or 100% sequence identity to the amino acid sequence of SEQ ID NO: 12212;

(123) (a) the VH may comprise an amino acid sequence with at least 90, 91, 92, 93, 94, 95, 96, 97, 98, 99, or 100% sequence identity to the amino acid sequence of SEQ ID NO: 12302, and (b) the VL may comprise an amino acid sequence with at least 90, 91, 92, 93, 94, 95, 96, 97, 98, 99, or 100% sequence identity to the amino acid sequence of SEQ ID NO: 12312;

(124) (a) the VH may comprise an amino acid sequence with at least 90, 91, 92, 93, 94, 95, 96, 97, 98, 99, or 100% sequence identity to the amino acid sequence of SEQ ID NO: 12402, and (b) the VL may comprise an amino acid sequence with at least 90, 91, 92, 93, 94, 95, 96, 97, 98, 99, or 100% sequence identity to the amino acid sequence of SEQ ID NO: 12412;

(125) (a) the VH may comprise an amino acid sequence with at least 90, 91, 92, 93, 94, 95, 96, 97, 98, 99, or 100% sequence identity to the amino acid sequence of SEQ ID NO: 12502, and (b) the VL may comprise an amino acid sequence with at least 90, 91, 92, 93, 94, 95, 96, 97, 98, 99, or 100% sequence identity to the amino acid sequence of SEQ ID NO: 12512;

(126) (a) the VH may comprise an amino acid sequence with at least 90, 91, 92, 93, 94, 95, 96, 97, 98, 99, or 100% sequence identity to the amino acid sequence of SEQ ID NO: 12602, and (b) the VL may comprise an amino acid sequence with at least 90, 91, 92, 93, 94, 95, 96, 97, 98, 99, or 100% sequence identity to the amino acid sequence of SEQ ID NO: 12612;

(127) (a) the VH may comprise an amino acid sequence with at least 90, 91, 92, 93, 94, 95, 96, 97, 98, 99, or 100% sequence identity to the amino acid sequence of SEQ ID NO: 12702, and (b) the VL may comprise an amino acid sequence with at least 90, 91, 92, 93, 94, 95, 96, 97, 98, 99, or 100% sequence identity to the amino acid sequence of SEQ ID NO: 12712;

(128) (a) the VH may comprise an amino acid sequence with at least 90, 91, 92, 93, 94, 95, 96, 97, 98, 99, or 100% sequence identity to the amino acid sequence of SEQ ID NO: 12802, and (b) the VL may comprise an amino acid sequence with at least 90, 91, 92, 93, 94, 95, 96, 97, 98, 99, or 100% sequence identity to the amino acid sequence of SEQ ID NO: 12812;

(129) (a) the VH may comprise an amino acid sequence with at least 90, 91, 92, 93, 94, 95, 96, 97, 98, 99, or 100% sequence identity to the amino acid sequence of SEQ ID NO: 12902, and (b) the VL may comprise an amino acid sequence with at least 90, 91, 92, 93, 94, 95, 96, 97, 98, 99, or 100% sequence identity to the amino acid sequence of SEQ ID NO: 12912;

(130) (a) the VH may comprise an amino acid sequence with at least 90, 91, 92, 93, 94, 95, 96, 97, 98, 99, or 100% sequence identity to the amino acid sequence of SEQ ID NO: 13002, and (b) the VL may comprise an amino acid sequence with at least 90, 91, 92, 93, 94, 95, 96, 97, 98, 99, or 100% sequence identity to the amino acid sequence of SEQ ID NO: 13012;

(131) (a) the VH may comprise an amino acid sequence with at least 90, 91, 92, 93, 94, 95, 96, 97, 98, 99, or 100% sequence identity to the amino acid sequence of SEQ ID NO: 13102, and (b) the VL may comprise an amino acid sequence with at least 90, 91, 92, 93, 94, 95, 96, 97, 98, 99, or 100% sequence identity to the amino acid sequence of SEQ ID NO: 13112;

(132) (a) the VH may comprise an amino acid sequence with at least 90, 91, 92, 93, 94, 95, 96, 97, 98, 99, or 100% sequence identity to the amino acid sequence of SEQ ID NO: 13202, and (b) the VL may comprise an amino acid sequence with at least 90, 91, 92, 93, 94, 95, 96, 97, 98, 99, or 100% sequence identity to the amino acid sequence of SEQ ID NO: 13212;

(133) (a) the VH may comprise an amino acid sequence with at least 90, 91, 92, 93, 94, 95, 96, 97, 98, 99, or 100% sequence identity to the amino acid sequence of SEQ ID NO: 13302, and (b) the VL may comprise an amino acid sequence with at least 90, 91, 92, 93, 94, 95, 96, 97, 98, 99, or 100% sequence identity to the amino acid sequence of SEQ ID NO: 13312;

(134) (a) the VH may comprise an amino acid sequence with at least 90, 91, 92, 93, 94, 95, 96, 97, 98, 99, or 100% sequence identity to the amino acid sequence of SEQ ID NO: 13402, and (b) the VL may comprise an amino acid sequence with at least 90, 91, 92, 93, 94, 95, 96, 97, 98, 99, or 100% sequence identity to the amino acid sequence of SEQ ID NO: 13412;

(135) (a) the VH may comprise an amino acid sequence with at least 90, 91, 92, 93, 94, 95, 96, 97, 98, 99, or 100% sequence identity to the amino acid sequence of SEQ ID NO: 13502, and (b) the VL may comprise an amino acid sequence with at least 90, 91, 92, 93, 94, 95, 96, 97, 98, 99, or 100% sequence identity to the amino acid sequence of SEQ ID NO: 13512;

(136) (a) the VH may comprise an amino acid sequence with at least 90, 91, 92, 93, 94, 95, 96, 97, 98, 99, or 100% sequence identity to the amino acid sequence of SEQ ID NO: 13602, and (b) the VL may comprise an amino acid sequence with at least 90, 91, 92, 93, 94, 95, 96, 97, 98, 99, or 100% sequence identity to the amino acid sequence of SEQ ID NO: 13612;

(137) (a) the VH may comprise an amino acid sequence with at least 90, 91, 92, 93, 94, 95, 96, 97, 98, 99, or 100% sequence identity to the amino acid sequence of SEQ ID NO: 13702, and (b) the VL may comprise an amino acid sequence with at least 90, 91, 92, 93, 94, 95, 96, 97, 98, 99, or 100% sequence identity to the amino acid sequence of SEQ ID NO: 13712;

(138) (a) the VH may comprise an amino acid sequence with at least 90, 91, 92, 93, 94, 95, 96, 97, 98, 99, or 100% sequence identity to the amino acid sequence of SEQ ID NO: 13802, and (b) the VL may comprise an amino acid sequence with at least 90, 91, 92, 93, 94, 95, 96, 97, 98, 99, or 100% sequence identity to the amino acid sequence of SEQ ID NO: 13812;

(139) (a) the VH may comprise an amino acid sequence with at least 90, 91, 92, 93, 94, 95, 96, 97, 98, 99, or 100% sequence identity to the amino acid sequence of SEQ ID NO: 13902, and (b) the VL may comprise an amino acid sequence with at least 90, 91, 92, 93, 94, 95, 96, 97, 98, 99, or 100% sequence identity to the amino acid sequence of SEQ ID NO: 13912;

(140) (a) the VH may comprise an amino acid sequence with at least 90, 91, 92, 93, 94, 95, 96, 97, 98, 99, or 100% sequence identity to the amino acid sequence of SEQ ID NO: 14002, and (b) the VL may comprise an amino acid sequence with at least 90, 91, 92, 93, 94, 95, 96, 97, 98, 99, or 100% sequence identity to the amino acid sequence of SEQ ID NO: 14012;

(141) (a) the VH may comprise an amino acid sequence with at least 90, 91, 92, 93, 94, 95, 96, 97, 98, 99, or 100% sequence identity to the amino acid sequence of SEQ ID NO: 14102, and (b) the VL may comprise an amino acid sequence with at least 90, 91, 92, 93, 94, 95, 96, 97, 98, 99, or 100% sequence identity to the amino acid sequence of SEQ ID NO: 14112;

(142) (a) the VH may comprise an amino acid sequence with at least 90, 91, 92, 93, 94, 95, 96, 97, 98, 99, or 100% sequence identity to the amino acid sequence of SEQ ID NO: 14202, and (b) the VL may comprise an amino acid sequence with at least 90, 91, 92, 93, 94, 95, 96, 97, 98, 99, or 100% sequence identity to the amino acid sequence of SEQ ID NO: 14212;

(143) (a) the VH may comprise an amino acid sequence with at least 90, 91, 92, 93, 94, 95, 96, 97, 98, 99, or 100% sequence identity to the amino acid sequence of SEQ ID NO: 14302, and (b) the VL may comprise an amino acid sequence with at least 90, 91, 92, 93, 94, 95, 96, 97, 98, 99, or 100% sequence identity to the amino acid sequence of SEQ ID NO: 14312;

(144) (a) the VH may comprise an amino acid sequence with at least 90, 91, 92, 93, 94, 95, 96, 97, 98, 99, or 100% sequence identity to the amino acid sequence of SEQ ID NO: 14402, and (b) the VL may comprise an amino acid sequence with at least 90, 91, 92, 93, 94, 95, 96, 97, 98, 99, or 100% sequence identity to the amino acid sequence of SEQ ID NO: 14412;

(145) (a) the VH may comprise an amino acid sequence with at least 90, 91, 92, 93, 94, 95, 96, 97, 98, 99, or 100% sequence identity to the amino acid sequence of SEQ ID NO: 14502, and (b) the VL may comprise an amino acid sequence with at least 90, 91, 92, 93, 94, 95, 96, 97, 98, 99, or 100% sequence identity to the amino acid sequence of SEQ ID NO: 14512;

(146) (a) the VH may comprise an amino acid sequence with at least 90, 91, 92, 93, 94, 95, 96, 97, 98, 99, or 100% sequence identity to the amino acid sequence of SEQ ID NO: 14602, and (b) the VL may comprise an amino acid sequence with at least 90, 91, 92, 93, 94, 95, 96, 97, 98, 99, or 100% sequence identity to the amino acid sequence of SEQ ID NO: 14612;

(147) (a) the VH may comprise an amino acid sequence with at least 90, 91, 92, 93, 94, 95, 96, 97, 98, 99, or 100% sequence identity to the amino acid sequence of SEQ ID NO: 14702, and (b) the VL may comprise an amino acid sequence with at least 90, 91, 92, 93, 94, 95, 96, 97, 98, 99, or 100% sequence identity to the amino acid sequence of SEQ ID NO: 14712;

(148) (a) the VH may comprise an amino acid sequence with at least 90, 91, 92, 93, 94, 95, 96, 97, 98, 99, or 100% sequence identity to the amino acid sequence of SEQ ID NO: 14802, and (b) the VL may comprise an amino acid sequence with at least 90, 91, 92, 93, 94, 95, 96, 97, 98, 99, or 100% sequence identity to the amino acid sequence of SEQ ID NO: 14812;

(149) (a) the VH may comprise an amino acid sequence with at least 90, 91, 92, 93, 94, 95, 96, 97, 98, 99, or 100% sequence identity to the amino acid sequence of SEQ ID NO: 14902, and (b) the VL comprises an amino acid sequence with at least 90, 91, 92, 93, 94, 95, 96, 97, 98, 99, or 100% sequence identity to the amino acid sequence of SEQ ID NO: 14912;

(150) (a) the VH may comprise an amino acid sequence with at least 90, 91, 92, 93, 94, 95, 96, 97, 98, 99, or 100% sequence identity to the amino acid sequence of SEQ ID NO: 15002, and (b) the VL may comprise an amino acid sequence with at least 90, 91, 92, 93, 94, 95, 96, 97, 98, 99, or 100% sequence identity to the amino acid sequence of SEQ ID NO: 15012;

(151) (a) the VH may comprise an amino acid sequence with at least 90, 91, 92, 93, 94, 95, 96, 97, 98, 99, or 100% sequence identity to the amino acid sequence of SEQ ID NO: 15102, and (b) the VL may comprise an amino acid sequence with at least 90, 91, 92, 93, 94, 95, 96, 97, 98, 99, or 100% sequence identity to the amino acid sequence of SEQ ID NO: 15112;

(152) (a) the VH may comprise an amino acid sequence with at least 90, 91, 92, 93, 94, 95, 96, 97, 98, 99, or 100% sequence identity to the amino acid sequence of SEQ ID NO: 15202, and (b) the VL may comprise an amino acid sequence with at least 90, 91, 92, 93, 94, 95, 96, 97, 98, 99, or 100% sequence identity to the amino acid sequence of SEQ ID NO: 15212;

(153) (a) the VH may comprise an amino acid sequence with at least 90, 91, 92, 93, 94, 95, 96, 97, 98, 99, or 100% sequence identity to the amino acid sequence of SEQ ID NO: 15302, and (b) the VL may comprise an amino acid sequence with at least 90, 91, 92, 93, 94, 95, 96, 97, 98, 99, or 100% sequence identity to the amino acid sequence of SEQ ID NO: 15312;

(154) (a) the VH may comprise an amino acid sequence with at least 90, 91, 92, 93, 94, 95, 96, 97, 98, 99, or 100% sequence identity to the amino acid sequence of SEQ ID NO: 15402, and (b) the VL may comprise an amino acid sequence with at least 90, 91, 92, 93, 94, 95, 96, 97, 98, 99, or 100% sequence identity to the amino acid sequence of SEQ ID NO: 15412;

(155) (a) the VH may comprise an amino acid sequence with at least 90, 91, 92, 93, 94, 95, 96, 97, 98, 99, or 100% sequence identity to the amino acid sequence of SEQ ID NO: 15502, and (b) the VL may comprise an amino acid sequence with at least 90, 91, 92, 93, 94, 95, 96, 97, 98, 99, or 100% sequence identity to the amino acid sequence of SEQ ID NO: 15512;

(156) (a) the VH may comprise an amino acid sequence with at least 90, 91, 92, 93, 94, 95, 96, 97, 98, 99, or 100% sequence identity to the amino acid sequence of SEQ ID NO: 15602, and (b) the VL may comprise an amino acid sequence with at least 90, 91, 92, 93, 94, 95, 96, 97, 98, 99, or 100% sequence identity to the amino acid sequence of SEQ ID NO: 15612;

(157) (a) the VH may comprise an amino acid sequence with at least 90, 91, 92, 93, 94, 95, 96, 97, 98, 99, or 100% sequence identity to the amino acid sequence of SEQ ID NO: 15702, and (b) the VL may comprise an amino acid sequence with at least 90, 91, 92, 93, 94, 95, 96, 97, 98, 99, or 100% sequence identity to the amino acid sequence of SEQ ID NO: 15712;

(158) (a) the VH may comprise an amino acid sequence with at least 90, 91, 92, 93, 94, 95, 96, 97, 98, 99, or 100% sequence identity to the amino acid sequence of SEQ ID NO: 15802, and (b) the VL may comprise an amino acid sequence with at least 90, 91, 92, 93, 94, 95, 96, 97, 98, 99, or 100% sequence identity to the amino acid sequence of SEQ ID NO: 15812;

(159) (a) the VH may comprise an amino acid sequence with at least 90, 91, 92, 93, 94, 95, 96, 97, 98, 99, or 100% sequence identity to the amino acid sequence of SEQ ID NO: 15902, and (b) the VL may comprise an amino acid sequence with at least 90, 91, 92, 93, 94, 95, 96, 97, 98, 99, or 100% sequence identity to the amino acid sequence of SEQ ID NO: 15912;

(160) (a) the VH may comprise an amino acid sequence with at least 90, 91, 92, 93, 94, 95, 96, 97, 98, 99, or 100% sequence identity to the amino acid sequence of SEQ ID NO: 16002, and (b) the VL may comprise an amino acid sequence with at least 90, 91, 92, 93, 94, 95, 96, 97, 98, 99, or 100% sequence identity to the amino acid sequence of SEQ ID NO: 16012;

(161) (a) the VH may comprise an amino acid sequence with at least 90, 91, 92, 93, 94, 95, 96, 97, 98, 99, or 100% sequence identity to the amino acid sequence of SEQ ID NO: 16102, and (b) the VL may comprise an amino acid sequence with at least 90, 91, 92, 93, 94, 95, 96, 97, 98, 99, or 100% sequence identity to the amino acid sequence of SEQ ID NO: 16112;

(162) (a) the VH may comprise an amino acid sequence with at least 90, 91, 92, 93, 94, 95, 96, 97, 98, 99, or 100% sequence identity to the amino acid sequence of SEQ ID NO: 16202, and (b) the VL may comprise an amino acid sequence with at least 90, 91, 92, 93, 94, 95, 96, 97, 98, 99, or 100% sequence identity to the amino acid sequence of SEQ ID NO: 16212;

(163) (a) the VH may comprise an amino acid sequence with at least 90, 91, 92, 93, 94, 95, 96, 97, 98, 99, or 100% sequence identity to the amino acid sequence of SEQ ID NO: 16302, and (b) the VL may comprise an amino acid sequence with at least 90, 91, 92, 93, 94, 95, 96, 97, 98, 99, or 100% sequence identity to the amino acid sequence of SEQ ID NO: 16312;

(164) (a) the VH may comprise an amino acid sequence with at least 90, 91, 92, 93, 94, 95, 96, 97, 98, 99, or 100% sequence identity to the amino acid sequence of SEQ ID NO: 16402, and (b) the VL may comprise an amino acid sequence with at least 90, 91, 92, 93, 94, 95, 96, 97, 98, 99, or 100% sequence identity to the amino acid sequence of SEQ ID NO: 16412;

(165) (a) the VH may comprise an amino acid sequence with at least 90, 91, 92, 93, 94, 95, 96, 97, 98, 99, or 100% sequence identity to the amino acid sequence of SEQ ID NO: 16502, and (b) the VL may comprise an amino acid sequence with at least 90, 91, 92, 93, 94, 95, 96, 97, 98, 99, or 100% sequence identity to the amino acid sequence of SEQ ID NO: 16512;

(166) (a) the VH may comprise an amino acid sequence with at least 90, 91, 92, 93, 94, 95, 96, 97, 98, 99, or 100% sequence identity to the amino acid sequence of SEQ ID NO: 16602, and (b) the VL may comprise an amino acid sequence with at least 90, 91, 92, 93, 94, 95, 96, 97, 98, 99, or 100% sequence identity to the amino acid sequence of SEQ ID NO: 16612;

(167) (a) the VH may comprise an amino acid sequence with at least 90, 91, 92, 93, 94, 95, 96, 97, 98, 99, or 100% sequence identity to the amino acid sequence of SEQ ID NO: 16702, and (b) the VL may comprise an amino acid sequence with at least 90, 91, 92, 93, 94, 95, 96, 97, 98, 99, or 100% sequence identity to the amino acid sequence of SEQ ID NO: 16712;

(168) (a) the VH may comprise an amino acid sequence with at least 90, 91, 92, 93, 94, 95, 96, 97, 98, 99, or 100% sequence identity to the amino acid sequence of SEQ ID NO: 16802, and (b) the VL may comprise an amino acid sequence with at least 90, 91, 92, 93, 94, 95, 96, 97, 98, 99, or 100% sequence identity to the amino acid sequence of SEQ ID NO: 16812;

(169) (a) the VH may comprise an amino acid sequence with at least 90, 91, 92, 93, 94, 95, 96, 97, 98, 99, or 100% sequence identity to the amino acid sequence of SEQ ID NO: 16902, and (b) the VL may comprise an amino acid sequence with at least 90, 91, 92, 93, 94, 95, 96, 97, 98, 99, or 100% sequence identity to the amino acid sequence of SEQ ID NO: 16912;

(170) (a) the VH may comprise an amino acid sequence with at least 90, 91, 92, 93, 94, 95, 96, 97, 98, 99, or 100% sequence identity to the amino acid sequence of SEQ ID NO: 17002, and (b) the VL may comprise an amino acid sequence with at least 90, 91, 92, 93, 94, 95, 96, 97, 98, 99, or 100% sequence identity to the amino acid sequence of SEQ ID NO: 17012;

(171) (a) the VH may comprise an amino acid sequence with at least 90, 91, 92, 93, 94, 95, 96, 97, 98, 99, or 100% sequence identity to the amino acid sequence of SEQ ID NO: 17102, and (b) the VL may comprise an amino acid sequence with at least 90, 91, 92, 93, 94, 95, 96, 97, 98, 99, or 100% sequence identity to the amino acid sequence of SEQ ID NO: 17112;

(172) (a) the VH may comprise an amino acid sequence with at least 90, 91, 92, 93, 94, 95, 96, 97, 98, 99, or 100% sequence identity to the amino acid sequence of SEQ ID NO: 17202, and (b) the VL may comprise an amino acid sequence with at least 90, 91, 92, 93, 94, 95, 96, 97, 98, 99, or 100% sequence identity to the amino acid sequence of SEQ ID NO: 17212;

(173) (a) the VH may comprise an amino acid sequence with at least 90, 91, 92, 93, 94, 95, 96, 97, 98, 99, or 100% sequence identity to the amino acid sequence of SEQ ID NO: 17302, and (b) the VL may comprise an amino acid sequence with at least 90, 91, 92, 93, 94, 95, 96, 97, 98, 99, or 100% sequence identity to the amino acid sequence of SEQ ID NO: 17312;

(174) (a) the VH may comprise an amino acid sequence with at least 90, 91, 92, 93, 94, 95, 96, 97, 98, 99, or 100% sequence identity to the amino acid sequence of SEQ ID NO: 17402, and (b) the VL may comprise an amino acid sequence with at least 90, 91, 92, 93, 94, 95, 96, 97, 98, 99, or 100% sequence identity to the amino acid sequence of SEQ ID NO: 17412;

(175) (a) the VH may comprise an amino acid sequence with at least 90, 91, 92, 93, 94, 95, 96, 97, 98, 99, or 100% sequence identity to the amino acid sequence of SEQ ID NO: 17502, and (b) the VL may comprise an amino acid sequence with at least 90, 91, 92, 93, 94, 95, 96, 97, 98, 99, or 100% sequence identity to the amino acid sequence of SEQ ID NO: 17512;

(176) (a) the VH may comprise an amino acid sequence with at least 90, 91, 92, 93, 94, 95, 96, 97, 98, 99, or 100% sequence identity to the amino acid sequence of SEQ ID NO: 17602, and (b) the VL may comprise an amino acid sequence with at least 90, 91, 92, 93, 94, 95, 96, 97, 98, 99, or 100% sequence identity to the amino acid sequence of SEQ ID NO: 17612;

(177) (a) the VH may comprise an amino acid sequence with at least 90, 91, 92, 93, 94, 95, 96, 97, 98, 99, or 100% sequence identity to the amino acid sequence of SEQ ID NO: 17702, and (b) the VL may comprise an amino acid sequence with at least 90, 91, 92, 93, 94, 95, 96, 97, 98, 99, or 100% sequence identity to the amino acid sequence of SEQ ID NO: 17712;

(178) (a) the VH may comprise an amino acid sequence with at least 90, 91, 92, 93, 94, 95, 96, 97, 98, 99, or 100% sequence identity to the amino acid sequence of SEQ ID NO: 17802, and (b) the VL may comprise an amino acid sequence with at least 90, 91, 92, 93, 94, 95, 96, 97, 98, 99, or 100% sequence identity to the amino acid sequence of SEQ ID NO: 17812;

(179) (a) the VH may comprise an amino acid sequence with at least 90, 91, 92, 93, 94, 95, 96, 97, 98, 99, or 100% sequence identity to the amino acid sequence of SEQ ID NO: 17902, and (b) the VL may comprise an amino acid sequence with at least 90, 91, 92, 93, 94, 95, 96, 97, 98, 99, or 100% sequence identity to the amino acid sequence of SEQ ID NO: 17912;

(180) (a) the VH may comprise an amino acid sequence with at least 90, 91, 92, 93, 94, 95, 96, 97, 98, 99, or 100% sequence identity to the amino acid sequence of SEQ ID NO: 18002, and (b) the VL may comprise an amino acid sequence with at least 90, 91, 92, 93, 94, 95, 96, 97, 98, 99, or 100% sequence identity to the amino acid sequence of SEQ ID NO: 18012;

(181) (a) the VH may comprise an amino acid sequence with at least 90, 91, 92, 93, 94, 95, 96, 97, 98, 99, or 100% sequence identity to the amino acid sequence of SEQ ID NO: 18102, and (b) the VL may comprise an amino acid sequence with at least 90, 91, 92, 93, 94, 95, 96, 97, 98, 99, or 100% sequence identity to the amino acid sequence of SEQ ID NO: 18112;

(182) (a) the VH may comprise an amino acid sequence with at least 90, 91, 92, 93, 94, 95, 96, 97, 98, 99, or 100% sequence identity to the amino acid sequence of SEQ ID NO: 18202, and (b) the VL may comprise an amino acid sequence with at least 90, 91, 92, 93, 94, 95, 96, 97, 98, 99, or 100% sequence identity to the amino acid sequence of SEQ ID NO: 18212;

(183) (a) the VH may comprise an amino acid sequence with at least 90, 91, 92, 93, 94, 95, 96, 97, 98, 99, or 100% sequence identity to the amino acid sequence of SEQ ID NO: 18302, and (b) the VL may comprise an amino acid sequence with at least 90, 91, 92, 93, 94, 95, 96, 97, 98, 99, or 100% sequence identity to the amino acid sequence of SEQ ID NO: 18312;

(184) (a) the VH may comprise an amino acid sequence with at least 90, 91, 92, 93, 94, 95, 96, 97, 98, 99, or 100% sequence identity to the amino acid sequence of SEQ ID NO: 18402, and (b) the VL may comprise an amino acid sequence with at least 90, 91, 92, 93, 94, 95, 96, 97, 98, 99, or 100% sequence identity to the amino acid sequence of SEQ ID NO: 18412;

(185) (a) the VH may comprise an amino acid sequence with at least 90, 91, 92, 93, 94, 95, 96, 97, 98, 99, or 100% sequence identity to the amino acid sequence of SEQ ID NO: 18502, and (b) the VL may comprise an amino acid sequence with at least 90, 91, 92, 93, 94, 95, 96, 97, 98, 99, or 100% sequence identity to the amino acid sequence of SEQ ID NO: 18512;

(186) (a) the VH may comprise an amino acid sequence with at least 90, 91, 92, 93, 94, 95, 96, 97, 98, 99, or 100% sequence identity to the amino acid sequence of SEQ ID NO: 18602, and (b) the VL may comprise an amino acid sequence with at least 90, 91, 92, 93, 94, 95, 96, 97, 98, 99, or 100% sequence identity to the amino acid sequence of SEQ ID NO: 18612;

(187) (a) the VH may comprise an amino acid sequence with at least 90, 91, 92, 93, 94, 95, 96, 97, 98, 99, or 100% sequence identity to the amino acid sequence of SEQ ID NO: 18702, and (b) the VL may comprise an amino acid sequence with at least 90, 91, 92, 93, 94, 95, 96, 97, 98, 99, or 100% sequence identity to the amino acid sequence of SEQ ID NO: 18712;

(188) (a) the VH may comprise an amino acid sequence with at least 90, 91, 92, 93, 94, 95, 96, 97, 98, 99, or 100% sequence identity to the amino acid sequence of SEQ ID NO: 18802, and (b) the VL may comprise an amino acid sequence with at least 90, 91, 92, 93, 94, 95, 96, 97, 98, 99, or 100% sequence identity to the amino acid sequence of SEQ ID NO: 18812;

(189) (a) the VH may comprise an amino acid sequence with at least 90, 91, 92, 93, 94, 95, 96, 97, 98, 99, or 100% sequence identity to the amino acid sequence of SEQ ID NO: 18902, and (b) the VL may comprise an amino acid sequence with at least 90, 91, 92, 93, 94, 95, 96, 97, 98, 99, or 100% sequence identity to the amino acid sequence of SEQ ID NO: 18912;

(190) (a) the VH may comprise an amino acid sequence with at least 90, 91, 92, 93, 94, 95, 96, 97, 98, 99, or 100% sequence identity to the amino acid sequence of SEQ ID NO: 19002, and (b) the VL may comprise an amino acid sequence with at least 90, 91, 92, 93, 94, 95, 96, 97, 98, 99, or 100% sequence identity to the amino acid sequence of SEQ ID NO: 19012;

(191) (a) the VH may comprise an amino acid sequence with at least 90, 91, 92, 93, 94, 95, 96, 97, 98, 99, or 100% sequence identity to the amino acid sequence of SEQ ID NO: 19102, and (b) the VL may comprise an amino acid sequence with at least 90, 91, 92, 93, 94, 95, 96, 97, 98, 99, or 100% sequence identity to the amino acid sequence of SEQ ID NO: 19112;

(192) (a) the VH may comprise an amino acid sequence with at least 90, 91, 92, 93, 94, 95, 96, 97, 98, 99, or 100% sequence identity to the amino acid sequence of SEQ ID NO: 19202, and (b) the VL comprises an amino acid sequence with at least 90, 91, 92, 93, 94, 95, 96, 97, 98, 99, or 100% sequence identity to the amino acid sequence of SEQ ID NO: 19212;

(193) (a) the VH may comprise an amino acid sequence with at least 90, 91, 92, 93, 94, 95, 96, 97, 98, 99, or 100% sequence identity to the amino acid sequence of SEQ ID NO: 19302, and (b) the VL may comprise an amino acid sequence with at least 90, 91, 92, 93, 94, 95, 96, 97, 98, 99, or 100% sequence identity to the amino acid sequence of SEQ ID NO: 19312;

(194) (a) the VH may comprise an amino acid sequence with at least 90, 91, 92, 93, 94, 95, 96, 97, 98, 99, or 100% sequence identity to the amino acid sequence of SEQ ID NO: 19402, and (b) the VL may comprise an amino acid sequence with at least 90, 91, 92, 93, 94, 95, 96, 97, 98, 99, or 100% sequence identity to the amino acid sequence of SEQ ID NO: 19412;

(195) (a) the VH may comprise an amino acid sequence with at least 90, 91, 92, 93, 94, 95, 96, 97, 98, 99, or 100% sequence identity to the amino acid sequence of SEQ ID NO: 19502, and (b) the VL may comprise an amino acid sequence with at least 90, 91, 92, 93, 94, 95, 96, 97, 98, 99, or 100% sequence identity to the amino acid sequence of SEQ ID NO: 19512;

(196) (a) the VH may comprise an amino acid sequence with at least 90, 91, 92, 93, 94, 95, 96, 97, 98, 99, or 100% sequence identity to the amino acid sequence of SEQ ID NO: 19602, and (b) the VL may comprise an amino acid sequence with at least 90, 91, 92, 93, 94, 95, 96, 97, 98, 99, or 100% sequence identity to the amino acid sequence of SEQ ID NO: 19612;

(197) (a) the VH may comprise an amino acid sequence with at least 90, 91, 92, 93, 94, 95, 96, 97, 98, 99, or 100% sequence identity to the amino acid sequence of SEQ ID NO: 19702, and (b) the VL may comprise an amino acid sequence with at least 90, 91, 92, 93, 94, 95, 96, 97, 98, 99, or 100% sequence identity to the amino acid sequence of SEQ ID NO: 19712;

(198) (a) the VH may comprise an amino acid sequence with at least 90, 91, 92, 93, 94, 95, 96, 97, 98, 99, or 100% sequence identity to the amino acid sequence of SEQ ID NO: 19802, and (b) the VL may comprise an amino acid sequence with at least 90, 91, 92, 93, 94, 95, 96, 97, 98, 99, or 100% sequence identity to the amino acid sequence of SEQ ID NO: 19812;

(199) (a) the VH may comprise an amino acid sequence with at least 90, 91, 92, 93, 94, 95, 96, 97, 98, 99, or 100% sequence identity to the amino acid sequence of SEQ ID NO: 19902, and (b) the VL may comprise an amino acid sequence with at least 90, 91, 92, 93, 94, 95, 96, 97, 98, 99, or 100% sequence identity to the amino acid sequence of SEQ ID NO: 19912;

(200) (a) the VH may comprise an amino acid sequence with at least 90, 91, 92, 93, 94, 95, 96, 97, 98, 99, or 100% sequence identity to the amino acid sequence of SEQ ID NO: 20002, and (b) the VL may comprise an amino acid sequence with at least 90, 91, 92, 93, 94, 95, 96, 97, 98, 99, or 100% sequence identity to the amino acid sequence of SEQ ID NO: 20012;

(201) (a) the VH may comprise an amino acid sequence with at least 90, 91, 92, 93, 94, 95, 96, 97, 98, 99, or 100% sequence identity to the amino acid sequence of SEQ ID NO: 20102, and (b) the VL may comprise an amino acid sequence with at least 90, 91, 92, 93, 94, 95, 96, 97, 98, 99, or 100% sequence identity to the amino acid sequence of SEQ ID NO: 20112;

(202) (a) the VH may comprise an amino acid sequence with at least 90, 91, 92, 93, 94, 95, 96, 97, 98, 99, or 100% sequence identity to the amino acid sequence of SEQ ID NO: 20202, and (b) the VL may comprise an amino acid sequence with at least 90, 91, 92, 93, 94, 95, 96, 97, 98, 99, or 100% sequence identity to the amino acid sequence of SEQ ID NO: 20212;

(203) (a) the VH may comprise an amino acid sequence with at least 90, 91, 92, 93, 94, 95, 96, 97, 98, 99, or 100% sequence identity to the amino acid sequence of SEQ ID NO: 20302, and (b) the VL may comprise an amino acid sequence with at least 90, 91, 92, 93, 94, 95, 96, 97, 98, 99, or 100% sequence identity to the amino acid sequence of SEQ ID NO: 20312;

(204) (a) the VH may comprise an amino acid sequence with at least 90, 91, 92, 93, 94, 95, 96, 97, 98, 99, or 100% sequence identity to the amino acid sequence of SEQ ID NO: 20402, and (b) the VL may comprise an amino acid sequence with at least 90, 91, 92, 93, 94, 95, 96, 97, 98, 99, or 100% sequence identity to the amino acid sequence of SEQ ID NO: 20412;

(205) (a) the VH may comprise an amino acid sequence with at least 90, 91, 92, 93, 94, 95, 96, 97, 98, 99, or 100% sequence identity to the amino acid sequence of SEQ ID NO: 20502, and (b) the VL may comprise an amino acid sequence with at least 90, 91, 92, 93, 94, 95, 96, 97, 98, 99, or 100% sequence identity to the amino acid sequence of SEQ ID NO: 20512;

(206) (a) the VH may comprise an amino acid sequence with at least 90, 91, 92, 93, 94, 95, 96, 97, 98, 99, or 100% sequence identity to the amino acid sequence of SEQ ID NO: 20602, and (b) the VL may comprise an amino acid sequence with at least 90, 91, 92, 93, 94, 95, 96, 97, 98, 99, or 100% sequence identity to the amino acid sequence of SEQ ID NO: 20612;

(207) (a) the VH may comprise an amino acid sequence with at least 90, 91, 92, 93, 94, 95, 96, 97, 98, 99, or 100% sequence identity to the amino acid sequence of SEQ ID NO: 20702, and (b) the VL may comprise an amino acid sequence with at least 90, 91, 92, 93, 94, 95, 96, 97, 98, 99, or 100% sequence identity to the amino acid sequence of SEQ ID NO: 20712;

(208) (a) the VH may comprise an amino acid sequence with at least 90, 91, 92, 93, 94, 95, 96, 97, 98, 99, or 100% sequence identity to the amino acid sequence of SEQ ID NO: 20802, and (b) the VL may comprise an amino acid sequence with at least 90, 91, 92, 93, 94, 95, 96, 97, 98, 99, or 100% sequence identity to the amino acid sequence of SEQ ID NO: 20812;

(209) (a) the VH may comprise an amino acid sequence with at least 90, 91, 92, 93, 94, 95, 96, 97, 98, 99, or 100% sequence identity to the amino acid sequence of SEQ ID NO: 20902, and (b) the VL may comprise an amino acid sequence with at least 90, 91, 92, 93, 94, 95, 96, 97, 98, 99, or 100% sequence identity to the amino acid sequence of SEQ ID NO: 20912;

(210) (a) the VH may comprise an amino acid sequence with at least 90, 91, 92, 93, 94, 95, 96, 97, 98, 99, or 100% sequence identity to the amino acid sequence of SEQ ID NO: 21002, and (b) the VL may comprise an amino acid sequence with at least 90, 91, 92, 93, 94, 95, 96, 97, 98, 99, or 100% sequence identity to the amino acid sequence of SEQ ID NO: 21012;

(211) (a) the VH may comprise an amino acid sequence with at least 90, 91, 92, 93, 94, 95, 96, 97, 98, 99, or 100% sequence identity to the amino acid sequence of SEQ ID NO: 21102, and (b) the VL may comprise an amino acid sequence with at least 90, 91, 92, 93, 94, 95, 96, 97, 98, 99, or 100% sequence identity to the amino acid sequence of SEQ ID NO: 21112;

(212) (a) the VH may comprise an amino acid sequence with at least 90, 91, 92, 93, 94, 95, 96, 97, 98, 99, or 100% sequence identity to the amino acid sequence of SEQ ID NO: 21202, and (b) the VL may comprise an amino acid sequence with at least 90, 91, 92, 93, 94, 95, 96, 97, 98, 99, or 100% sequence identity to the amino acid sequence of SEQ ID NO: 21212;

(213) (a) the VH may comprise an amino acid sequence with at least 90, 91, 92, 93, 94, 95, 96, 97, 98, 99, or 100% sequence identity to the amino acid sequence of SEQ ID NO: 21302, and (b) the VL may comprise an amino acid sequence with at least 90, 91, 92, 93, 94, 95, 96, 97, 98, 99, or 100% sequence identity to the amino acid sequence of SEQ ID NO: 21312;

(214) (a) the VH may comprise an amino acid sequence with at least 90, 91, 92, 93, 94, 95, 96, 97, 98, 99, or 100% sequence identity to the amino acid sequence of SEQ ID NO: 21402, and (b) the VL may comprise an amino acid sequence with at least 90, 91, 92, 93, 94, 95, 96, 97, 98, 99, or 100% sequence identity to the amino acid sequence of SEQ ID NO: 21412;

(215) (a) the VH may comprise an amino acid sequence with at least 90, 91, 92, 93, 94, 95, 96, 97, 98, 99, or 100% sequence identity to the amino acid sequence of SEQ ID NO: 21502, and (b) the VL may comprise an amino acid sequence with at least 90, 91, 92, 93, 94, 95, 96, 97, 98, 99, or 100% sequence identity to the amino acid sequence of SEQ ID NO: 21512;

(216) (a) the VH may comprise an amino acid sequence with at least 90, 91, 92, 93, 94, 95, 96, 97, 98, 99, or 100% sequence identity to the amino acid sequence of SEQ ID NO: 21602, and (b) the VL may comprise an amino acid sequence with at least 90, 91, 92, 93, 94, 95, 96, 97, 98, 99, or 100% sequence identity to the amino acid sequence of SEQ ID NO: 21612;

(217) (a) the VH may comprise an amino acid sequence with at least 90, 91, 92, 93, 94, 95, 96, 97, 98, 99, or 100% sequence identity to the amino acid sequence of SEQ ID NO: 21702, and (b) the VL may comprise an amino acid sequence with at least 90, 91, 92, 93, 94, 95, 96, 97, 98, 99, or 100% sequence identity to the amino acid sequence of SEQ ID NO: 21712;

(218) (a) the VH may comprise an amino acid sequence with at least 90, 91, 92, 93, 94, 95, 96, 97, 98, 99, or 100% sequence identity to the amino acid sequence of SEQ ID NO: 21802, and (b) the VL may comprise an amino acid sequence with at least 90, 91, 92, 93, 94, 95, 96, 97, 98, 99, or 100% sequence identity to the amino acid sequence of SEQ ID NO: 21812;

(219) (a) the VH may comprise an amino acid sequence with at least 90, 91, 92, 93, 94, 95, 96, 97, 98, 99, or 100% sequence identity to the amino acid sequence of SEQ ID NO: 21902, and (b) the VL may comprise an amino acid sequence with at least 90, 91, 92, 93, 94, 95, 96, 97, 98, 99, or 100% sequence identity to the amino acid sequence of SEQ ID NO: 21912;

(220) (a) the VH may comprise an amino acid sequence with at least 90, 91, 92, 93, 94, 95, 96, 97, 98, 99, or 100% sequence identity to the amino acid sequence of SEQ ID NO: 22002, and (b) the VL may comprise an amino acid sequence with at least 90, 91, 92, 93, 94, 95, 96, 97, 98, 99, or 100% sequence identity to the amino acid sequence of SEQ ID NO: 22012; or (221) (a) the VH may comprise an amino acid sequence with at least 90, 91, 92, 93, 94, 95, 96, 97, 98, 99, or 100% sequence identity to the amino acid sequence of SEQ ID NO: 22102, and (b) the VL may comprise an amino acid sequence with at least 90, 91, 92, 93, 94, 95, 96, 97, 98, 99, or 100% sequence identity to the amino acid sequence of SEQ ID NO: 22112, (222) (a) the VH may comprise an amino acid sequence with at least 90, 91, 92, 93, 94, 95, 96, 97, 98, 99, or 100% sequence identity to the amino acid sequence of SEQ ID NO: 22202, and (b) the VL may comprise an amino acid sequence with at least 90, 91, 92, 93, 94, 95, 96, 97, 98, 99, or 100% sequence identity to the amino acid sequence of SEQ ID NO: 22212;

(223) (a) the VH may comprise an amino acid sequence with at least 90, 91, 92, 93, 94, 95, 96, 97, 98, 99, or 100% sequence identity to the amino acid sequence of SEQ ID NO: 22302, and (b) the VL may comprise an amino acid sequence with at least 90, 91, 92, 93, 94, 95, 96, 97, 98, 99, or 100% sequence identity to the amino acid sequence of SEQ ID NO: 22312;

(224) (a) the VH may comprise an amino acid sequence with at least 90, 91, 92, 93, 94, 95, 96, 97, 98, 99, or 100% sequence identity to the amino acid sequence of SEQ ID NO: 22402, and (b) the VL may comprise an amino acid sequence with at least 90, 91, 92, 93, 94, 95, 96, 97, 98, 99, or 100% sequence identity to the amino acid sequence of SEQ ID NO: 22412;

(225) (a) the VH may comprise an amino acid sequence with at least 90, 91, 92, 93, 94, 95, 96, 97, 98, 99, or 100% sequence identity to the amino acid sequence of SEQ ID NO: 22502, and (b) the VL may comprise an amino acid sequence with at least 90, 91, 92, 93, 94, 95, 96, 97, 98, 99, or 100% sequence identity to the amino acid sequence of SEQ ID NO: 22512;

(226) (a) the VH may comprise an amino acid sequence with at least 90, 91, 92, 93, 94, 95, 96, 97, 98, 99, or 100% sequence identity to the amino acid sequence of SEQ ID NO: 22602, and (b) the VL may comprise an amino acid sequence with at least 90, 91, 92, 93, 94, 95, 96, 97, 98, 99, or 100% sequence identity to the amino acid sequence of SEQ ID NO: 22612; or (227) (a) the VH may comprise an amino acid sequence with at least 90, 91, 92, 93, 94, 95, 96, 97, 98, 99, or 100% sequence identity to the amino acid sequence of SEQ ID NO: 22702, and (b) the VL may comprise an amino acid sequence with at least 90, 91, 92, 93, 94, 95, 96, 97, 98, 99, or 100% sequence identity to the amino acid sequence of SEQ ID NO: 22712;

(228) (a) the VH may comprise an amino acid sequence with at least 90, 91, 92, 93, 94, 95, 96, 97, 98, 99, or 100% sequence identity to the amino acid sequence of SEQ ID NO: 22802, and (b) the VL may comprise an amino acid sequence with at least 90, 91, 92, 93, 94, 95, 96, 97, 98, 99, or 100% sequence identity to the amino acid sequence of SEQ ID NO: 22812;

(229) (a) the VH may comprise an amino acid sequence with at least 90, 91, 92, 93, 94, 95, 96, 97, 98, 99, or 100% sequence identity to the amino acid sequence of SEQ ID NO: 22902, and (b) the VL may comprise an amino acid sequence with at least 90, 91, 92, 93, 94, 95, 96, 97, 98, 99, or 100% sequence identity to the amino acid sequence of SEQ ID NO: 22912;

(230) (a) the VH may comprise an amino acid sequence with at least 90, 91, 92, 93, 94, 95, 96, 97, 98, 99, or 100% sequence identity to the amino acid sequence of SEQ ID NO: 23002, and (b) the VL may comprise an amino acid sequence with at least 90, 91, 92, 93, 94, 95, 96, 97, 98, 99, or 100% sequence identity to the amino acid sequence of SEQ ID NO: 23012; or (231) (a) the VH may comprise an amino acid sequence with at least 90, 91, 92, 93, 94, 95, 96, 97, 98, 99, or 100% sequence identity to the amino acid sequence of SEQ ID NO: 23102, and (b) the VL may comprise an amino acid sequence with at least 90, 91, 92, 93, 94, 95, 96, 97, 98, 99, or 100% sequence identity to the amino acid sequence of SEQ ID NO: 23112.

In some embodiments, the isolated antibody or antigen-binding antibody fragment, optionally an affinity-matured variant of any of the anti-CoV-S antibodies disclosed herein, may possess one of the following structural features:

(1) (a) the VH may comprise an amino acid sequence with at least 90, 91, 92, 93, 94, 95, 96, 97, 98, 99, or 100% sequence identity to the amino acid sequence of SEQ ID NO: 102, and (b) the VL may comprise an amino acid sequence with at least 90, 91, 92, 93, 94, 95, 96, 97, 98, 99, or 100% sequence identity to the amino acid sequence of SEQ ID NO: 112;

(2) (a) the VH may comprise an amino acid sequence with at least 90, 91, 92, 93, 94, 95, 96, 97, 98, 99, or 100% sequence identity to the amino acid sequence of SEQ ID NO: 202, and (b) the VL may comprise an amino acid sequence with at least 90, 91, 92, 93, 94, 95, 96, 97, 98, 99, or 100% sequence identity to the amino acid sequence of SEQ ID NO: 212;

(3) (a) the VH may comprise an amino acid sequence with at least 90, 91, 92, 93, 94, 95, 96, 97, 98, 99, or 100% sequence identity to the amino acid sequence of SEQ ID NO: 302, and (b) the VL may comprise an amino acid sequence with at least 90, 91, 92, 93, 94, 95, 96, 97, 98, 99, or 100% sequence identity to the amino acid sequence of SEQ ID NO: 312;

(86) (a) the VH may comprise an amino acid sequence with at least 90, 91, 92, 93, 94, 95, 96, 97, 98, 99, or 100% sequence identity to the amino acid sequence of SEQ ID NO: 8602, and (b) the VL may comprise an amino acid sequence with at least 90, 91, 92, 93, 94, 95, 96, 97, 98, 99, or 100% sequence identity to the amino acid sequence of SEQ ID NO: 8612;

(123) (a) the VH may comprise an amino acid sequence with at least 90, 91, 92, 93, 94, 95, 96, 97, 98, 99, or 100% sequence identity to the amino acid sequence of SEQ ID NO: 12302, and (b) the VL may comprise an amino acid sequence with at least 90, 91, 92, 93, 94, 95, 96, 97, 98, 99, or 100% sequence identity to the amino acid sequence of SEQ ID NO: 12312;

(130) (a) the VH may comprise an amino acid sequence with at least 90, 91, 92, 93, 94, 95, 96, 97, 98, 99, or 100% sequence identity to the amino acid sequence of SEQ ID NO: 13002, and (b) the VL may comprise an amino acid sequence with at least 90, 91, 92, 93, 94, 95, 96, 97, 98, 99, or 100% sequence identity to the amino acid sequence of SEQ ID NO: 13012;

(140) (a) the VH may comprise an amino acid sequence with at least 90, 91, 92, 93, 94, 95, 96, 97, 98, 99, or 100% sequence identity to the amino acid sequence of SEQ ID NO: 14002, and (b) the VL may comprise an amino acid sequence with at least 90, 91, 92, 93, 94, 95, 96, 97, 98, 99, or 100% sequence identity to the amino acid sequence of SEQ ID NO: 14012;

(162) (a) the VH may comprise an amino acid sequence with at least 90, 91, 92, 93, 94, 95, 96, 97, 98, 99, or 100% sequence identity to the amino acid sequence of SEQ ID NO: 16202, and (b) the VL may comprise an amino acid sequence with at least 90, 91, 92, 93, 94, 95, 96, 97, 98, 99, or 100% sequence identity to the amino acid sequence of SEQ ID NO: 16212;

(175) (a) the VH may comprise an amino acid sequence with at least 90, 91, 92, 93, 94, 95, 96, 97, 98, 99, or 100% sequence identity to the amino acid sequence of SEQ ID NO: 17502, and (b) the VL may comprise an amino acid sequence with at least 90, 91, 92, 93, 94, 95, 96, 97, 98, 99, or 100% sequence identity to the amino acid sequence of SEQ ID NO: 17512.

In further embodiments:

(212) (a) the VH may comprise an amino acid sequence with at least 90, 91, 92, 93, 94, 95, 96, 97, 98, 99, or 100% sequence identity to the amino acid sequence of SEQ ID NO: 21202, and (b) the VL may comprise an amino acid sequence with at least 90, 91, 92, 93, 94, 95, 96, 97, 98, 99, or 100% sequence identity to the amino acid sequence of SEQ ID NO: 21212;

(213) (a) the VH may comprise an amino acid sequence with at least 90, 91, 92, 93, 94, 95, 96, 97, 98, 99, or 100% sequence identity to the amino acid sequence of SEQ ID NO: 21302, and (b) the VL may comprise an amino acid sequence with at least 90, 91, 92, 93, 94, 95, 96, 97, 98, 99, or 100% sequence identity to the amino acid sequence of SEQ ID NO: 21312;

(214) (a) the VH may comprise an amino acid sequence with at least 90, 91, 92, 93, 94, 95, 96, 97, 98, 99, or 100% sequence identity to the amino acid sequence of SEQ ID NO: 21402, and (b) the VL may comprise an amino acid sequence with at least 90, 91, 92, 93, 94, 95, 96, 97, 98, 99, or 100% sequence identity to the amino acid sequence of SEQ ID NO: 21412;

(215) (a) the VH may comprise an amino acid sequence with at least 90, 91, 92, 93, 94, 95, 96, 97, 98, 99, or 100% sequence identity to the amino acid sequence of SEQ ID NO: 21502, and (b) the VL may comprise an amino acid sequence with at least 90, 91, 92, 93, 94, 95, 96, 97, 98, 99, or 100% sequence identity to the amino acid sequence of SEQ ID NO: 21512;

(216) (a) the VH may comprise an amino acid sequence with at least 90, 91, 92, 93, 94, 95, 96, 97, 98, 99, or 100% sequence identity to the amino acid sequence of SEQ ID NO: 21602, and (b) the VL may comprise an amino acid sequence with at least 90, 91, 92, 93, 94, 95, 96, 97, 98, 99, or 100% sequence identity to the amino acid sequence of SEQ ID NO: 21612;

(217) (a) the VH may comprise an amino acid sequence with at least 90, 91, 92, 93, 94, 95, 96, 97, 98, 99, or 100% sequence identity to the amino acid sequence of SEQ ID NO: 21702, and (b) the VL may comprise an amino acid sequence with at least 90, 91, 92, 93, 94, 95, 96, 97, 98, 99, or 100% sequence identity to the amino acid sequence of SEQ ID NO: 21712;

(218) (a) the VH may comprise an amino acid sequence with at least 90, 91, 92, 93, 94, 95, 96, 97, 98, 99, or 100% sequence identity to the amino acid sequence of SEQ ID NO: 21802, and (b) the VL may comprise an amino acid sequence with at least 90, 91, 92, 93, 94, 95, 96, 97, 98, 99, or 100% sequence identity to the amino acid sequence of SEQ ID NO: 21812;

(219) (a) the VH may comprise an amino acid sequence with at least 90, 91, 92, 93, 94, 95, 96, 97, 98, 99, or 100% sequence identity to the amino acid sequence of SEQ ID NO: 21902, and (b) the VL may comprise an amino acid sequence with at least 90, 91, 92, 93, 94, 95, 96, 97, 98, 99, or 100% sequence identity to the amino acid sequence of SEQ ID NO: 21912;

(220) (a) the VH may comprise an amino acid sequence with at least 90, 91, 92, 93, 94, 95, 96, 97, 98, 99, or 100% sequence identity to the amino acid sequence of SEQ ID NO: 22002, and (b) the VL may comprise an amino acid sequence with at least 90, 91, 92, 93, 94, 95, 96, 97, 98, 99, or 100% sequence identity to the amino acid sequence of SEQ ID NO: 22012; or (221) (a) the VH may comprise an amino acid sequence with at least 90, 91, 92, 93, 94, 95, 96, 97, 98, 99, or 100% sequence identity to the amino acid sequence of SEQ ID NO: 22102, and (b) the VL may comprise an amino acid sequence with at least 90, 91, 92, 93, 94, 95, 96, 97, 98, 99, or 100% sequence identity to the amino acid sequence of SEQ ID NO: 22112, (222) (a) the VH may comprise an amino acid sequence with at least 90, 91, 92, 93, 94, 95, 96, 97, 98, 99, or 100% sequence identity to the amino acid sequence of SEQ ID NO: 22202, and (b) the VL may comprise an amino acid sequence with at least 90, 91, 92, 93, 94, 95, 96, 97, 98, 99, or 100% sequence identity to the amino acid sequence of SEQ ID NO: 22212;

(223) (a) the VH may comprise an amino acid sequence with at least 90, 91, 92, 93, 94, 95, 96, 97, 98, 99, or 100% sequence identity to the amino acid sequence of SEQ ID NO: 22302, and (b) the VL may comprise an amino acid sequence with at least 90, 91, 92, 93, 94, 95, 96, 97, 98, 99, or 100% sequence identity to the amino acid sequence of SEQ ID NO: 22312;

(224) (a) the VH may comprise an amino acid sequence with at least 90, 91, 92, 93, 94, 95, 96, 97, 98, 99, or 100% sequence identity to the amino acid sequence of SEQ ID NO: 22402, and (b) the VL may comprise an amino acid sequence with at least 90, 91, 92, 93, 94, 95, 96, 97, 98, 99, or 100% sequence identity to the amino acid sequence of SEQ ID NO: 22412;

(225) (a) the VH may comprise an amino acid sequence with at least 90, 91, 92, 93, 94, 95, 96, 97, 98, 99, or 100% sequence identity to the amino acid sequence of SEQ ID NO: 22502, and (b) the VL may comprise an amino acid sequence with at least 90, 91, 92, 93, 94, 95, 96, 97, 98, 99, or 100% sequence identity to the amino acid sequence of SEQ ID NO: 22512;

(226) (a) the VH may comprise an amino acid sequence with at least 90, 91, 92, 93, 94, 95, 96, 97, 98, 99, or 100% sequence identity to the amino acid sequence of SEQ ID NO: 22602, and (b) the VL may comprise an amino acid sequence with at least 90, 91, 92, 93, 94, 95, 96, 97, 98, 99, or 100% sequence identity to the amino acid sequence of SEQ ID NO: 22612;

(227) (a) the VH may comprise an amino acid sequence with at least 90, 91, 92, 93, 94, 95, 96, 97, 98, 99, or 100% sequence identity to the amino acid sequence of SEQ ID NO: 22702, and (b) the VL may comprise an amino acid sequence with at least 90, 91, 92, 93, 94, 95, 96, 97, 98, 99, or 100% sequence identity to the amino acid sequence of SEQ ID NO: 22712

(228) (a) the VH may comprise an amino acid sequence with at least 90, 91, 92, 93, 94, 95, 96, 97, 98, 99, or 100% sequence identity to the amino acid sequence of SEQ ID NO: 22802, and (b) the VL may comprise an amino acid sequence with at least 90, 91, 92, 93, 94, 95, 96, 97, 98, 99, or 100% sequence identity to the amino acid sequence of SEQ ID NO: 22812;

(229) (a) the VH may comprise an amino acid sequence with at least 90, 91, 92, 93, 94, 95, 96, 97, 98, 99, or 100% sequence identity to the amino acid sequence of SEQ ID NO: 22902, and (b) the VL may comprise an amino acid sequence with at least 90, 91, 92, 93, 94, 95, 96, 97, 98, 99, or 100% sequence identity to the amino acid sequence of SEQ ID NO: 22912;

(230) (a) the VH may comprise an amino acid sequence with at least 90, 91, 92, 93, 94, 95, 96, 97, 98, 99, or 100% sequence identity to the amino acid sequence of SEQ ID NO: 23002, and (b) the VL may comprise an amino acid sequence with at least 90, 91, 92, 93, 94, 95, 96, 97, 98, 99, or 100% sequence identity to the amino acid sequence of SEQ ID NO: 23012; or.

(231) (a) the VH may comprise an amino acid sequence with at least 90, 91, 92, 93, 94, 95, 96, 97, 98, 99, or 100% sequence identity to the amino acid sequence of SEQ ID NO: 23102, and (b) the VL may comprise an amino acid sequence with at least 90, 91, 92, 93, 94, 95, 96, 97, 98, 99, or 100% sequence identity to the amino acid sequence of SEQ ID NO: 23112.

In further preferred embodiments:

(217) (a) the VH may comprise an amino acid sequence with at least 90, 91, 92, 93, 94, 95, 96, 97, 98, 99, or 100% sequence identity to the amino acid sequence of SEQ ID NO: 21702, and (b) the VL may comprise an amino acid sequence with at least 90, 91, 92, 93, 94, 95, 96, 97, 98, 99, or 100% sequence identity to the amino acid sequence of SEQ ID NO: 21712;

(218) (a) the VH may comprise an amino acid sequence with at least 90, 91, 92, 93, 94, 95, 96, 97, 98, 99, or 100% sequence identity to the amino acid sequence of SEQ ID NO: 21802, and (b) the VL may comprise an amino acid sequence with at least 90, 91, 92, 93, 94, 95, 96, 97, 98, 99, or 100% sequence identity to the amino acid sequence of SEQ ID NO: 21812;

(219) (a) the VH may comprise an amino acid sequence with at least 90, 91, 92, 93, 94, 95, 96, 97, 98, 99, or 100% sequence identity to the amino acid sequence of SEQ ID NO: 21902, and (b) the VL may comprise an amino acid sequence with at least 90, 91, 92, 93, 94, 95, 96, 97, 98, 99, or 100% sequence identity to the amino acid sequence of SEQ ID NO: 21912;

(220) (a) the VH may comprise an amino acid sequence with at least 90, 91, 92, 93, 94, 95, 96, 97, 98, 99, or 100% sequence identity to the amino acid sequence of SEQ ID NO: 22002, and (b) the VL may comprise an amino acid sequence with at least 90, 91, 92, 93, 94, 95, 96, 97, 98, 99, or 100% sequence identity to the amino acid sequence of SEQ ID NO: 22012; or (221) (a) the VH may comprise an amino acid sequence with at least 90, 91, 92, 93, 94, 95, 96, 97, 98, 99, or 100% sequence identity to the amino acid sequence of SEQ ID NO: 22102, and (b) the VL may comprise an amino acid sequence with at least 90, 91, 92, 93, 94, 95, 96, 97, 98, 99, or 100% sequence identity to the amino acid sequence of SEQ ID NO: 22112, (222) (a) the VH may comprise an amino acid sequence with at least 90, 91, 92, 93, 94, 95, 96, 97, 98, 99, or 100% sequence identity to the amino acid sequence of SEQ ID NO: 22202, and (b) the VL may comprise an amino acid sequence with at least 90, 91, 92, 93, 94, 95, 96, 97, 98, 99, or 100% sequence identity to the amino acid sequence of SEQ ID NO: 22212;

(223) (a) the VH may comprise an amino acid sequence with at least 90, 91, 92, 93, 94, 95, 96, 97, 98, 99, or 100% sequence identity to the amino acid sequence of SEQ ID NO: 22302, and (b) the VL may comprise an amino acid sequence with at least 90, 91, 92, 93, 94, 95, 96, 97, 98, 99, or 100% sequence identity to the amino acid sequence of SEQ ID NO: 22312;

(224) (a) the VH may comprise an amino acid sequence with at least 90, 91, 92, 93, 94, 95, 96, 97, 98, 99, or 100% sequence identity to the amino acid sequence of SEQ ID NO: 22402, and (b) the VL may comprise an amino acid sequence with at least 90, 91, 92, 93, 94, 95, 96, 97, 98, 99, or 100% sequence identity to the amino acid sequence of SEQ ID NO: 22412; or (225) (a) the VH may comprise an amino acid sequence with at least 90, 91, 92, 93, 94, 95, 96, 97, 98, 99, or 100% sequence identity to the amino acid sequence of SEQ ID NO: 22502, and (b) the VL may comprise an amino acid sequence with at least 90, 91, 92, 93, 94, 95, 96, 97, 98, 99, or 100% sequence identity to the amino acid sequence of SEQ ID NO: 22512.

In some embodiments, the present disclosure provides an isolated antibody, or antigen-binding fragment thereof, which specifically binds to the spike protein of a coronavirus ("CoV-S"), wherein said antibody, or antigen-binding fragment thereof, comprises at least one, e.g., two, three, four, five or six, of the following sequences:

(a) a heavy chain variable region (VH) comprising a VH CDR1 having a sequence of $X_1X_2FX_3X_4X_5X_6X_7X_8$ (SEQ ID NO: 23205), wherein $X_1$ is F or Y, $X_2$ is T or S, $X_3$ is S or T, $X_4$ is S, R, G, H, T, A, or K, $X_5$ Is F or Y, $X_6$ is Y, A, D, G, P, or V, $X_7$ is M or I, and $X_8$ is H or N;

(b) a heavy chain variable region (VH) comprising a VH CDR1 having a sequence of $X_1TFX_2SYYX_3X_4$ (SEQ ID NO: 23206), wherein $X_1$ is F or Y, $X_2$ is T or S, $X_3$ is M or I, and $X_4$ is H or N;

(c) a heavy chain variable region (VH) comprising a VH CDR1 having a sequence of FTFSSYYMN (SEQ ID NO: 23207);

(d) a heavy chain variable region (VH) comprising a VH CDR2 having a sequence of SISX$_1$DGYX$_2$TYYPDSLKG (SEQ ID NO: 23208), wherein $X_1$ is S or E and $X_2$ is N or S;

(e) a heavy chain variable region (VH) comprising a VH CDR3 having a sequence of ARDFSGHTAX$_1$AGTGFEY (SEQ ID NO: 23209), wherein $X_1$ is W or V;

(f) a light chain variable region (VL) comprising a VL CDR1 having a sequence of TSGX$_1$SNX$_2$GAGYX$_3$VH (SEQ ID NO: 23210), wherein $X_1$ is N or S, $X_2$ is I or V, and $X_3$ is D or Y;

(g) a light chain variable region (VL) comprising a VL CDR2 having a sequence of $GX_1X_2X_3X_4X_5X_6$ (SEQ ID NO: 23211), wherein $X_1$ is A, S, or T, $X_2$ is S or T, $X_3$ is S, T, A, or N, $X_4$ is R, L, or T, $X_5$ is A, P, Q, H, or N, and $X_6$ is T or S;

(h) a light chain variable region (VL) comprising a VL CDR2 having a sequence of GX$_1$SSX$_2$X$_3$S (SEQ ID NO: 23212), wherein $X_1$ is S or A, $X_2$ is R or L, and $X_3$ is N, H, or Q;

(i) a light chain variable region (VL) comprising a VL CDR2 having a sequence of GSSSRNS (SEQ ID NO: 23213); and (j) a light chain variable region (VL) comprising a VL CDR3 having a sequence of QSYDSSLSVLYX$_1$ (SEQ ID NO: 23214), wherein $X_1$ is T or V.

In some embodiments, the antibody, or antigen-binding fragment thereof, comprises a heavy chain variable region (VH) comprising a VH CDR3 having a sequence of ARDFSGHTAX$_1$AGTGFEY (SEQ ID NO: 23209), wherein $X_1$ is W or V, and a light chain variable region (VL) comprising a VL CDR3 having a sequence of QSYDSSLSVLYX$_1$ (SEQ ID NO: 23214), wherein $X_1$ is T or V.

In other embodiments, the antibody, or antigen-binding fragment thereof, comprises a heavy chain variable region (VH) comprising a VH CDR3 having a sequence of ARDFSGHTAX$_1$AGTGFEY (SEQ ID NO: 23209), wherein X$_1$ is W or V; a VH CDR2 having a sequence of SISX$_1$DGYX$_2$TYYPDSLKG (SEQ ID NO: 23208), wherein X$_1$ is S or E and X$_2$ is N or S; and a VH CDR1 having a sequence of X$_1$TFX$_2$SYYX$_3$X$_4$ (SEQ ID NO: 23206), wherein X$_1$ is F or Y, X$_2$ is T or S, X$_3$ is M or I, and X$_4$ is H or N; and a light chain variable region (VL) comprising a VL CDR3 having a sequence of QSYDSSLSVLYX$_1$ (SEQ ID NO: 23214), wherein X$_1$ is T or V; a VL CDR2 having a sequence of GX$_1$SSX$_2$X$_3$S (SEQ ID NO: 23212), wherein X$_1$ is S or A, X$_2$ is R or L, and X$_3$ is N, H, or Q; and a VL CDR1 having a sequence of TSGX$_1$SNX$_2$GAGYX$_3$VH (SEQ ID NO: 23210), wherein X$_1$ is N or S, X$_2$ is I or V, and X$_3$ is D or Y.

In some embodiments, the present disclosure provides an isolated antibody, or antigen-binding fragment thereof, which specifically binds to the spike protein of a coronavirus ("CoV-S"), wherein said antibody, or antigen-binding fragment thereof, comprises at least one, e.g., two, three, four, five or six, of the following sequences:
  (a) a heavy chain variable region (VH) comprising a VH CDR1 having a sequence of X$_1$X$_2$FX$_3$X$_4$X$_5$X$_6$X$_7$X$_8$ (SEQ ID NO: 23205), wherein X$_1$ is F or Y, X$_2$ is T or S, X$_3$ is S or T, X$_4$ is S, R, G, H, T, A, or K, X$_5$ Is F or Y, X$_6$ is Y, A, D, G, P, or V, X$_7$ is M or I, and X$_8$ is H or N;
  (b) a heavy chain variable region (VH) comprising a VH CDR1 having a sequence of FTFSX$_1$X$_2$AMH (SEQ ID NO: 23215), wherein X$_1$ is R or K and X$_2$ is F or Y;
  (c) a heavy chain variable region (VH) comprising a VH CDR1 having a sequence of FTFSRFAMH (SEQ ID NO: 23216);
  (d) a heavy chain variable region (VH) comprising a VH CDR2 having a sequence of AINLNGDSX$_1$YYTDSVRG (SEQ ID NO: 23217), wherein X$_1$ is K or T;
  (e) a heavy chain variable region (VH) comprising a VH CDR3 having a sequence of VKDGGYYDSSGPGH (SEQ ID NO: 23218);
  (f) a light chain variable region (VL) comprising a VL CDR1 having a sequence of RASX$_1$NX$_2$X$_3$X$_4$X$_5$LA (SEQ ID NO: 23219), wherein X$_1$ is E or Q, X$_2$ is I or V, X$_3$ is L, A, or N, X$_4$ is H or N, and X$_5$ is Y or W;
  (g) a light chain variable region (VL) comprising a VL CDR1 having a sequence of RASENIX$_1$HYLA (SEQ ID NO: 23220), wherein X$_1$ is L or A;
  (h) a light chain variable region (VL) comprising a VL CDR1 having a sequence of RASENILHYLA (SEQ ID NO: 23221);
  (i) a light chain variable region (VL) comprising a VL CDR2 having a sequence of X$_1$X$_2$X$_3$X$_4$RX$_5$X$_6$ (SEQ ID NO: 23222), wherein X$_1$ is D or E, X$_2$ is A, S, T, or V, X$_3$ is S or F, X$_4$ is S, A, T, K, N, or R; X$_5$ is A or V, and X$_6$ is T, S, or P;
  (j) a light chain variable region (VL) comprising a VL CDR2 having a sequence of DX$_1$SX$_2$RAT (SEQ ID NO: 23223), wherein X$_1$ is A, S, or V, X$_2$ is K or R;
  (k) a light chain variable region (VL) comprising a VL CDR2 having a sequence of DASRRAT (SEQ ID NO: 23224); and
  (l) a light chain variable region (VL) comprising a VL CDR3 having a sequence of QQRX$_1$NWPQN (SEQ ID NO: 23225), wherein X$_1$ is A or S.

In some embodiments, the antibody, or antigen-binding fragment thereof, comprises a heavy chain variable region (VH) comprising a VH CDR3 having a sequence of VKDG-GYYDSSGPGH (SEQ ID NO: 23218), and a light chain variable region (VL) comprising a VL CDR3 having a sequence of QQRX$_1$NWPQN (SEQ ID NO: 23225), wherein X$_1$ is A or S.

In some embodiments, the antibody, or antigen-binding fragment thereof, comprises a heavy chain variable region (VH) comprising a VH CDR3 having a sequence of VKDG-GYYDSSGPGH (SEQ ID NO: 23218); a VH CDR2 having a sequence of AINLNGDSX$_1$YYTDSVRG (SEQ ID NO: 23217), wherein X$_1$ is K or T; and a VH CDR1 having a sequence of FTFS X$_1$X$_2$AMH (SEQ ID NO: 23215), wherein X$_1$ is R or K and X$_2$ is F or Y; and a light chain variable region (VL) comprising a VL CDR3 having a sequence of QQRX$_1$NWPQN (SEQ ID NO: 23225), wherein X$_1$ is A or S; a VL CDR2 having a sequence of DX$_1$S X$_2$RAT (SEQ ID NO: 23223), wherein X$_1$ is A, S, or V, X$_2$ is K or R; and a VL CDR1 having a sequence of RASENIX$_1$HYLA (SEQ ID NO: 23220), wherein X$_1$ is L or A.

In some embodiments, the present disclosure provides an isolated antibody, or antigen-binding fragment thereof, which specifically binds to the spike protein of a coronavirus ("CoV-S"), wherein said antibody, or antigen-binding fragment thereof, comprises at least one, e.g., two, three, four, five or six, of the following sequences:
  (a) a heavy chain variable region (VH) comprising a VH CDR1 having a sequence of FPFX$_1$GTYMT (SEQ ID NO: 23226), wherein X$_1$ is K or S;
  (b) a heavy chain variable region (VH) comprising a VH CDR1 having a sequence of FX$_1$FX$_2$GX$_3$X$_4$MX$_5$ (SEQ ID NO: 23227), wherein X$_1$ is P or I, X$_2$ is K or S, X$_3$ is T or H, X$_4$ is W or Y, and X$_5$ is T or S;
  (c) a heavy chain variable region (VH) comprising a VH CDR2 having a sequence of IIYSGGDTYYADSVKG (SEQ ID NO: 23228);
  (d) a heavy chain variable region (VH) comprising a VH CDR2 having a sequence of X$_1$X$_2$YSGGX$_3$TYYADX$_4$VX$_5$G (SEQ ID NO: 23229), wherein X$_1$ is V or I, X$_2$ is L or I, X$_3$ is D or S, X$_4$ is S or A, and X$_5$ is K or Q;
  (e) a heavy chain variable region (VH) comprising a VH CDR3 having a sequence of ARDREMAIITERX$_1$YGLDV (SEQ ID NO: 23230), wherein X$_1$ is T or S;
  (f) a light chain variable region (VL) comprising a VL CDR1 having a sequence of SGGSSNIGSNSVN (SEQ ID NO: 23231);
  (g) a light chain variable region (VL) comprising a VL CDR1 having a sequence of SGX$_1$X$_2$X$_3$NIX$_4$SNX$_5$VN (SEQ ID NO: 23232), wherein X$_1$ G or S, X$_2$ is S or T, X$_3$ is S or A, X$_4$ is G or A, and X$_5$ is S or G;
  (h) a light chain variable region (VL) comprising a VL CDR2 having a sequence of X$_1$X$_2$SQRPS (SEQ ID NO: 23233), wherein X$_1$ is S or A and X$_2$ is N or V;
  (i) a light chain variable region (VL) comprising a VL CDR2 having a sequence of X$_1$X$_2$X$_3$X$_4$RPS (SEQ ID NO: 23234), wherein X$_1$ is G, S, or A, X$_2$ is N or V, X$_3$ is S or G, and X$_4$ is N or Q; and
  (j) a light chain variable region (VL) comprising a VL CDR3 having a sequence of AAWDDSLNTFRYV (SEQ ID NO: 23235).

In some embodiments, the present disclosure provides an isolated antibody, or antigen-binding fragment thereof, which specifically binds to the spike protein of a coronavirus ("CoV-S"), wherein said antibody, or antigen-binding fragment thereof, comprises at least one, e.g., two, three, four, five or six, of the following sequences:

(a) a heavy chain variable region (VH) comprising a VH CDR1 having a sequence of GTFSSX$_1$AIS (SEQ ID NO: 23236), wherein X$_1$ is Y or D;
(b) a heavy chain variable region (VH) comprising a VH CDR1 having a sequence of GX$_1$FX$_2$SX$_3$X$_4$X$_5$X$_6$ (SEQ ID NO: 23237), wherein X$_1$ is T, S, or P, X$_2$ is S or T, X$_3$ is Y, F, or D, X$_4$ is V, G, or A, X$_5$ is V, L, or I, and X$_6$ is S or T;
(c) a heavy chain variable region (VH) comprising a VH CDR2 having a sequence of GIIPIFVTANYAQKFQG (SEQ ID NO: 23238);
(d) a heavy chain variable region (VH) comprising a VH CDR2 having a sequence of GIX$_1$PIFX$_2$TX$_3$X$_4$YAQKFQX$_5$ (SEQ ID NO: 23239), wherein X$_1$ is I or M, X$_2$ is G or V, X$_3$ is A or T, X$_4$ is N or G, and X$_5$ is G or D;
(e) a heavy chain variable region (VH) comprising a VH CDR3 having a sequence of ARGRMATIR-GGQNYYYYYGMDV (SEQ ID NO: 23240);
(f) a light chain variable region (VL) comprising a VL CDR1 having a sequence of QASQDISNYLN (SEQ ID NO: 23241);
(g) a light chain variable region (VL) comprising a VL CDR1 having a sequence of QASQDIX$_1$X$_2$X$_3$LN (SEQ ID NO: 23242), wherein X$_1$ is S or R, X$_2$ is N or K, and X$_3$ is Y or C;
(h) a light chain variable region (VL) comprising a VL CDR2 having a sequence of DASNLET (SEQ ID NO: 23243);
(i) a light chain variable region (VL) comprising a VL CDR2 having a sequence of X$_1$X$_2$SX$_3$LX$_4$X$_5$ (SEQ ID NO: 23244), wherein X$_1$ is V, A, S, T, D, E, K, or R, X$_2$ is A, V, or T, X$_3$ is S, N, T, or K, X$_4$ is Q, E, K, or R, and X$_5$ is S, N, or T;
(j) a light chain variable region (VL) comprising a VL CDR3 having a sequence of QQYDNLPLT (SEQ ID NO: 23245);
(k) a light chain variable region (VL) comprising a VL CDR3 having a sequence of QQX$_1$X$_2$X$_3$LPX$_4$T (SEQ ID NO: 23246), wherein X$_1$ is Y or F, X$_2$ is D or E, X$_3$ is N or D, and X$_4$ is L or I; and
(l) a light chain variable region (VL) comprising a VL CDR3 having a sequence of QX$_1$X$_2$X$_3$X$_4$X$_5$PX$_6$X$_7$ (SEQ ID NO: 23247), wherein X$_1$ is Q or H, X$_2$ is Y, A, or F, X$_3$ is D or E, X$_4$ is N, S, or D, X$_5$ is L, Y, or F, X$_6$ is I, L, T, V, or F, and X$_7$ is T or A.

In some embodiments, the present disclosure provides an isolated antibody, or antigen-binding fragment thereof, which specifically binds to the spike protein of a coronavirus ("CoV-S"), wherein said antibody, or antigen-binding fragment thereof, comprises at least one, e.g., two, three, four, five or six, of the following sequences:
(a) a heavy chain variable region (VH) comprising a VH CDR1 having a sequence of FTFDDYAMH (SEQ ID NO: 23248);
(b) a heavy chain variable region (VH) comprising a VH CDR1 having a sequence of FX$_1$X$_2$DDYAX$_3$H (SEQ ID NO: 23249), wherein X$_1$ is T or I, X$_2$ is F or L, and X$_3$ is M or V; (c) a heavy chain variable region (VH) comprising a VH CDR2 having a sequence of GISWNSGX$_1$INYADSVX$_2$G (SEQ ID NO: 23250), wherein X$_1$ is T or S and X$_2$ is M or K;
(d) a heavy chain variable region (VH) comprising a VH CDR2 having a sequence of GIX$_1$WNSGX$_2$X$_3$X$_4$YADSVX$_5$G (SEQ ID NO: 23251), wherein X$_1$ is S or T, X$_2$ is S, T, or Y, X$_3$ is I or L, X$_4$ is N or G, and X$_5$ is K or M;
(e) a heavy chain variable region (VH) comprising a VH CDR3 having a sequence of ASDSNYRDYYY-HYGMDV (SEQ ID NO: 23252);
(f) a light chain variable region (VL) comprising a VL CDR1 having a sequence of RSSQSLLHSX$_1$GYNYLD (SEQ ID NO: 23253), wherein X$_1$ is N or Q;
(g) a light chain variable region (VL) comprising a VL CDR2 having a sequence of LGSNRAS (SEQ ID NO: 23254);
(h) a light chain variable region (VL) comprising a VL CDR2 having a sequence of X$_1$X$_2$X$_3$X$_4$RX$_5$S (SEQ ID NO: 23255), wherein X$_1$ is L or G, X$_2$ is G or N, X$_3$ is S or N, X$_4$ is N or E, and X$_5$ is A or 5;
(i) a light chain variable region (VL) comprising a VL CDR3 having a sequence of MQALQTPRT (SEQ ID NO: 23256); and
(j) a light chain variable region (VL) comprising a VL CDR3 having a sequence of MQX$_1$X$_2$X$_3$X$_4$X$_5$X$_6$X$_7$T (SEQ ID NO: 23257), wherein X$_1$ is A or S, X$_2$ is L or I, X$_3$ is Q or no amino acid, X$_4$ is Q or T, X$_5$ is T, P, or V, X$_6$ is P or G, and X$_7$ is R, I, or V.

In some exemplary embodiments the isolated antibody or antigen-binding antibody fragment, optionally an affinity-matured variant, may be human, humanized, primatized or chimeric.

In some exemplary embodiments the isolated antibody or antigen-binding antibody fragment, optionally an affinity-matured variant, may be bispecific or multispecific.

In some exemplary embodiments the isolated antibody or antigen-binding antibody fragment, optionally an affinity-matured variant, may comprise at least one first antigen-binding domain ("ABD") and at least one second ABD.

Here, the following features (a) and (b) may be met:
(a) the first ABD may comprise the VH CDR1, the VH CDR2, the VH CDR3, the VL CDR1, the VL CDR2, and the VL CDR3 of a first anti-CoV-S antibody selected from any one of anti-CoV-S antibodies described herein and in FIGS. 1, 2 and 36; and/or
(b) the second ABD may comprise the VH CDR1, the VH CDR2, the VH CDR3, the VL CDR1, the VL CDR2, and the VL CDR3 of a second anti-CoV-S antibody selected from any one of anti-CoV-S antibodies described herein and in FIGS. 1, 2 and 36.

Optionally, the first anti-CoV-S antibody may be same as the second anti-CoV-S antibody or may be different from the second anti-CoV-S antibody.

The first anti-CoV-S antibody and the second anti-CoV-S antibody may bind to the same or different coronavirus species. Optionally, the first CoV-S and the second CoV-S may be (i) both of SARS-CoV or (ii) both of SARS-CoV-2.

Further optionally, the first anti-CoV-S antibody may be same as the second anti-CoV-S antibody or may be different from the second anti-CoV-S antibody. Still further optionally, these antibodies may bind to the same or different epitopes on a CoV-S expressed by said SARS-CoV or SARS-CoV-2. Alternatively, the first anti-CoV-S antibody and the second anti-CoV-S antibody may bind to different coronaviruses, optionally wherein the first CoV-S and the second CoV-S are (i) SARS-CoV and of SARS-CoV-2 coronaviruses, respectively, or are (ii) SARS-CoV-2 and of SARS-CoV coronaviruses, respectively.

Furthermore, in some preferred embodiments, the following features (a) and (b) may be met:
(a) the first ABD may comprise the VH CDR1, the VH CDR2, the VH CDR3, the VL CDR1, the VL CDR2, and the VL CDR3 of a first anti-CoV-S antibody selected from the group consisting of ADI-55688, ADI-55689, ADI-55690, ADI-55951, ADI-55993, ADI-56000, ADI-56010, ADI-56032, ADI-56046, ADI-57983 (with primer mutation), ADI-57978 (with primer mutation), ADI-56868 (with primer mutation), ADI-56443 (with primer mutation), ADI-56479 (with primer mutation), ADI-58120, ADI-58121, ADI-58122, ADI-58123, ADI-58124, ADI-58125, ADI-58126, ADI-58127, ADI-58128, ADI-58129, ADI-58130, ADI-58131, ADI-58130_LCN30cQ, and ADI-59988; and (b) the second ABD may comprise the VH CDR1, the VH CDR2, the VH CDR3, the VL CDR1, the VL CDR2, and the VL CDR3 of a second anti-CoV-S antibody selected from the group consisting of ADI-55688, ADI-55689, ADI-55690, ADI-55951, ADI-55993, ADI-56000, ADI-56010, ADI-56032, ADI-56046, ADI-57983 (with primer mutation), ADI-57978 (with primer mutation), ADI-56868 (with primer mutation), ADI-56443 (with primer mutation), ADI-56479 (with primer mutation), ADI-57983, ADI-57978, ADI-56868, ADI-56443, and ADI-56479.

In some embodiments, the bispecific or multispecific isolated antibody or antigen-binding antibody fragment may comprise at least one first ABD and at least one second ABD.

In certain embodiments, (a) the first ABD may comprise the VH CDR1, the VH CDR2, the VH CDR3, the VL CDR1, the VL CDR2, and the VL CDR3 of a first anti-CoV-S antibody selected from any one of anti-CoV-S antibodies described herein and in FIGS. 1, 2 and 36, or an affinity-matured variant of any of the foregoing; and/or (b) the second ABD binds to an antigen which may not be a CoV-S, optionally wherein the antigen is a cytokine, a cytokine receptor, or an immunomodulatory polypeptide. In certain preferred embodiments, in (a), the first ABD may comprise the VH CDR1, the VH CDR2, the VH CDR3, the VL CDR1, the VL CDR2, and the VL CDR3 of a first anti-CoV-S antibody selected from the group consisting of ADI-55688, ADI-55689, ADI-55690, ADI-55951, ADI-55993, ADI-56000, ADI-56010, ADI-56032, ADI-56046, ADI-57983 (with primer mutation), ADI-57978 (with primer mutation), ADI-56868 (with primer mutation), ADI-56443 (with primer mutation), ADI-56479 (with primer mutation), ADI-57983, ADI-57978, ADI-56868, ADI-56443, and ADI-56479, particularly preferably selected from the group consisting of ADI-57983 (with primer mutation), ADI-57978 (with primer mutation), ADI-56868 (with primer mutation), ADI-56443 (with primer mutation), ADI-56479 (with primer mutation), ADI-58120, ADI-58121, ADI-58122, ADI-58123, ADI-58124, ADI-58125, ADI-58126, ADI-58127, ADI-58128, ADI-58129, ADI-58130, ADI-58131, ADI-58130_LCN30cQ, and ADI-59988.

In some embodiments, the isolated antibody or antigen-binding antibody fragment may comprise a Fab, Fab', $F(ab')_2$, scFv, $sc(Fv)_2$, minibody, diabody, sdAb, BITE.

In some embodiments, the isolated antibody or antigen-binding antibody fragment may comprise a constant region or Fc region or at least one domain thereof.

In certain embodiments, the constant region or Fc region may comprise a mutation which impairs or enhances at least one effector function, optionally FcR binding, FcRn binding, complement binding, glycosylation, complement-dependent cytotoxicity ("CDC"), or antibody-dependent cellular cytotoxicity ("ADCC").

In some embodiments, the constant or Fc region is primate derived, preferably human.

The human constant or Fc region optionally may be selected from a human IgG1, IgG2, IgG3 or IgG4 constant or Fc region which optionally may be modified, optionally such as by domain deletion or by introducing one or more mutations which impair or enhance at least one effector function.

The present disclosure further relates to chimeric antigen receptors ("CARS") comprising at least one antibody or antigen-binding antibody fragment described herein.

The present disclosure further relates to antibody-drug conjugates "(ADCs") comprising: (a) at least one antibody or antigen-binding antibody fragment described herein; and (b) a drug.

In some embodiments, the drug may be: (i) an antiviral drug, which is optionally, remdesivir, favipiravir, darunavir, nelfinavir, saquinavir, lopinavir or ritonavir; (ii) an antihelminth drug, which may be optionally ivermectin; (iii) an antiparasite drug, which may be optionally hydroxychloroquine, chloroquine, or atovaquone; (iv) antibacterial vaccine, which may be optionally the tuberculosis vaccine BCG; or (v) an anti-inflammatory drug, which may be optionally a steroid such as ciclesonide, a TNF inhibitor (e.g., adalimumab), a TNF receptor inhibitor (e.g., etanercept), an IL-6 inhibitor (e.g., clazakizumab), an IL-6 receptor inhibitor (e.g., toclizumab), or metamizole; (vi) an antihistamine drug, which may be optionally bepotastine; (vii) an ACE inhibitor, which may be optionally moexipril; (viii) a drug that inhibits priming of CoV-S, which may be optionally a serine protease inhibitor such as nafamostat; or (ix) a cytotoxic drug, which may be optionally daunorubicin, mitoxantrone, doxorubicin, cucurbitacin, chaetocin, chaetoglobosin, chlamydocin, calicheamicin, nemorubicin, cryptophyscin, mensacarcin, ansamitocin, mitomycin C, geldanamycin, mechercharmycin, rebeccamycin, safracin, okilactomycin, oligomycin, actinomycin, sandramycin, hypothemycin, polyketomycin, hydroxyellipticine, thiocolchicine, methotrexate, triptolide, taltobulin, lactacystin, dolastatin, auristatin, monomethyl auristatin E (MMAE), monomethyl auristatin F (MMAF), telomestatin, tubastatin A, combretastatin, maytansinoid, MMAD, MMAF, DM1, DM4, DTT, 16-GMB-APA-GA, 17-DMAP-GA, JW 55, pyrrolobenzodiazepine, SN-38, Ro 5-3335, puwainaphycin, duocarmycin, bafilomycin, taxoid, tubulysin, ferulenol, lusiol A, fumagillin, hygrolidin, glucopiericidin, amanitin, ansatrienin, cinerubin, phallacidin, phalloidin, phytosphongosine, piericidin, poronetin, phodophyllotoxin, gramicidin A, sanguinarine, sinefungin, herboxidiene, microcolin B, microcystin, muscotoxin A, tolytoxin, tripolin A, myoseverin, mytoxin B, nocuolin A, psuedolaric acid B, pseurotin A, cyclopamine, curvulin, colchicine, aphidicolin, englerin, cordycepin, apoptolidin, epothilone A, limaquinone, isatropolone, isofistularin, quinaldopeptin, ixabepilone, aeroplysinin, arruginosin, agrochelin, or epothilone.

The present disclosure also relates to isolated nucleic acids encoding any of the antibodies or antigen-binding antibody fragments disclosed herein.

In some embodiments, the nucleic acid may comprise:

(212) (a) a nucleic acid sequence with at least 90, 91, 92, 93, 94, 95, 96, 97, 98, 99, or 100% sequence identity to the nucleic acid sequence of SEQ ID NO: 21210, and/or (b) a nucleic acid sequence with at least 90, 91, 92, 93, 94, 95, 96, 97, 98, 99, or 100% sequence identity to the nucleic acid sequence of SEQ ID NO: 21220;

(213) (a) a nucleic acid sequence with at least 90, 91, 92, 93, 94, 95, 96, 97, 98, 99, or 100% sequence identity to the nucleic acid sequence of SEQ ID NO: 21310, and/or (b) a nucleic acid sequence with at least 90, 91, 92, 93, 94, 95, 96, 97, 98, 99, or 100% sequence identity to the nucleic acid sequence of SEQ ID NO: 21320;

(214) (a) a nucleic acid sequence with at least 90, 91, 92, 93, 94, 95, 96, 97, 98, 99, or 100% sequence identity to the nucleic acid sequence of SEQ ID NO: 21410, and/or (b) a nucleic acid sequence with at least 90, 91, 92, 93, 94, 95, 96, 97, 98, 99, or 100% sequence identity to the nucleic acid sequence of SEQ ID NO: 21420;
(215) (a) a nucleic acid sequence with at least 90, 91, 92, 93, 94, 95, 96, 97, 98, 99, or 100% sequence identity to the nucleic acid sequence of SEQ ID NO: 21510, and/or (b) a nucleic acid sequence with at least 90, 91, 92, 93, 94, 95, 96, 97, 98, 99, or 100% sequence identity to the nucleic acid sequence of SEQ ID NO: 21520;
(216) (a) a nucleic acid sequence with at least 90, 91, 92, 93, 94, 95, 96, 97, 98, 99, or 100% sequence identity to the nucleic acid sequence of SEQ ID NO: 21610, and/or (b) a nucleic acid sequence with at least 90, 91, 92, 93, 94, 95, 96, 97, 98, 99, or 100% sequence identity to the nucleic acid sequence of SEQ ID NO: 21620;
(217) (a) a nucleic acid sequence with at least 90, 91, 92, 93, 94, 95, 96, 97, 98, 99, or 100% sequence identity to the nucleic acid sequence of SEQ ID NO: 21710, and/or (b) a nucleic acid sequence with at least 90, 91, 92, 93, 94, 95, 96, 97, 98, 99, or 100% sequence identity to the nucleic acid sequence of SEQ ID NO: 21720;
(218) (a) a nucleic acid sequence with at least 90, 91, 92, 93, 94, 95, 96, 97, 98, 99, or 100% sequence identity to the nucleic acid sequence of SEQ ID NO: 21810, and/or (b) a nucleic acid sequence with at least 90, 91, 92, 93, 94, 95, 96, 97, 98, 99, or 100% sequence identity to the nucleic acid sequence of SEQ ID NO: 21820;
(219) (a) a nucleic acid sequence with at least 90, 91, 92, 93, 94, 95, 96, 97, 98, 99, or 100% sequence identity to the nucleic acid sequence of SEQ ID NO: 21910, and/or (b) a nucleic acid sequence with at least 90, 91, 92, 93, 94, 95, 96, 97, 98, 99, or 100% sequence identity to the nucleic acid sequence of SEQ ID NO: 21920;
(220) (a) a nucleic acid sequence with at least 90, 91, 92, 93, 94, 95, 96, 97, 98, 99, or 100% sequence identity to the nucleic acid sequence of SEQ ID NO: 22010, and/or (b) a nucleic acid sequence with at least 90, 91, 92, 93, 94, 95, 96, 97, 98, 99, or 100% sequence identity to the nucleic acid sequence of SEQ ID NO: 22020;
(221) (a) a nucleic acid sequence with at least 90, 91, 92, 93, 94, 95, 96, 97, 98, 99, or 100% sequence identity to the nucleic acid sequence of SEQ ID NO: 22110, and/or (b) a nucleic acid sequence with at least 90, 91, 92, 93, 94, 95, 96, 97, 98, 99, or 100% sequence identity to the nucleic acid sequence of SEQ ID NO: 22120;
(222) (a) a nucleic acid sequence with at least 90, 91, 92, 93, 94, 95, 96, 97, 98, 99, or 100% sequence identity to the nucleic acid sequence of SEQ ID NO: 22210, and/or (b) a nucleic acid sequence with at least 90, 91, 92, 93, 94, 95, 96, 97, 98, 99, or 100% sequence identity to the nucleic acid sequence of SEQ ID NO: 22220;
(223) (a) a nucleic acid sequence with at least 90, 91, 92, 93, 94, 95, 96, 97, 98, 99, or 100% sequence identity to the nucleic acid sequence of SEQ ID NO: 22310, and/or (b) a nucleic acid sequence with at least 90, 91, 92, 93, 94, 95, 96, 97, 98, 99, or 100% sequence identity to the nucleic acid sequence of SEQ ID NO: 22320;
(224) (a) a nucleic acid sequence with at least 90, 91, 92, 93, 94, 95, 96, 97, 98, 99, or 100% sequence identity to the nucleic acid sequence of SEQ ID NO: 22410, and/or (b) a nucleic acid sequence with at least 90, 91, 92, 93, 94, 95, 96, 97, 98, 99, or 100% sequence identity to the nucleic acid sequence of SEQ ID NO: 22420;
(225) (a) a nucleic acid sequence with at least 90, 91, 92, 93, 94, 95, 96, 97, 98, 99, or 100% sequence identity to the nucleic acid sequence of SEQ ID NO: 22510, and/or (b) a nucleic acid sequence with at least 90, 91, 92, 93, 94, 95, 96, 97, 98, 99, or 100% sequence identity to the nucleic acid sequence of SEQ ID NO: 22520;
(226) (a) a nucleic acid sequence with at least 90, 91, 92, 93, 94, 95, 96, 97, 98, 99, or 100% sequence identity to the nucleic acid sequence of SEQ ID NO: 22610, and/or (b) a nucleic acid sequence with at least 90, 91, 92, 93, 94, 95, 96, 97, 98, 99, or 100% sequence identity to the nucleic acid sequence of SEQ ID NO: 22620;
(227) (a) a nucleic acid sequence with at least 90, 91, 92, 93, 94, 95, 96, 97, 98, 99, or 100% sequence identity to the nucleic acid sequence of SEQ ID NO: 22710, and/or (b) a nucleic acid sequence with at least 90, 91, 92, 93, 94, 95, 96, 97, 98, 99, or 100% sequence identity to the nucleic acid sequence of SEQ ID NO: 22720;
(228) (a) a nucleic acid sequence with at least 90, 91, 92, 93, 94, 95, 96, 97, 98, 99, or 100% sequence identity to the nucleic acid sequence of SEQ ID NO: 22810, and/or (b) a nucleic acid sequence with at least 90, 91, 92, 93, 94, 95, 96, 97, 98, 99, or 100% sequence identity to the nucleic acid sequence of SEQ ID NO: 22820;
(229) (a) a nucleic acid sequence with at least 90, 91, 92, 93, 94, 95, 96, 97, 98, 99, or 100% sequence identity to the nucleic acid sequence of SEQ ID NO: 22910, and/or (b) a nucleic acid sequence with at least 90, 91, 92, 93, 94, 95, 96, 97, 98, 99, or 100% sequence identity to the nucleic acid sequence of SEQ ID NO: 22920;
(230) (a) a nucleic acid sequence with at least 90, 91, 92, 93, 94, 95, 96, 97, 98, 99, or 100% sequence identity to the nucleic acid sequence of SEQ ID NO: 23010, and/or (b) a nucleic acid sequence with at least 90, 91, 92, 93, 94, 95, 96, 97, 98, 99, or 100% sequence identity to the nucleic acid sequence of SEQ ID NO: 23020; or
(231) (a) a nucleic acid sequence with at least 90, 91, 92, 93, 94, 95, 96, 97, 98, 99, or 100% sequence identity to the nucleic acid sequence of SEQ ID NO: 23110, and/or (b) a nucleic acid sequence with at least 90, 91, 92, 93, 94, 95, 96, 97, 98, 99, or 100% sequence identity to the nucleic acid sequence of SEQ ID NO: 23120.

The present disclosure also relates to isolated cells which may comprise any of the nucleic acids disclosed herein.

In some embodiments the cell may be a bacterial, yeast, insect, fungal, or mammalian cell, optionally a human cell, further optionally a CHO or HEK cell.

In some embodiments the cell may be a human immune cell, optionally a T, NK, B or dendritic cell.

The present disclosure further relates to methods of expressing the antibody or antigen-binding antibody fragment or the CAR disclosed herein.

In some embodiments, the method may comprise: (a) culturing the cell expressing an antibody or antigen-binding antibody fragment or CAR of the present disclosure under conditions that permit expression; and (b) optionally isolating the antibody or antigen-binding antibody fragment or the CAR from the cell or the culture medium containing the cell.

The present disclosure further relates to methods of identifying an antibody or an antigen-binding antibody fragment which specifically binds to CoV-S.

In some embodiments, the method may comprise: (a) obtaining antisera and/or B cells obtained from a patient infected with SARS-CoV or SARS-CoV-2, optionally wherein the patient recovered from SARS-CoV or SARS-CoV-2 infection or the patient is a convalescent patient infected with SARS-CoV or SARS-CoV-2; (b) contacting the antisera and/or B cells with the CoV-S; and (c) isolating an antibody or antigen-binding fragment thereof which specifically bind to the CoV-S. Optionally, the CoV-S is the spike protein of SARS-CoV ("SARS-CoV-S") or of SARS-CoV-2 ("SARS-CoV-2-S"). Further optionally, the CoV-S may comprise the amino acid sequence of SEQ ID NO: 1 (SARS-CoV-S, 1288 amino acids, Accession #PDB: 6VSB_B) or SEQ ID NO: 5 (SARS-CoV-2-S, 1273 amino acids, GenBank: QHD43416.1).

In some embodiments, the method may further detect that the antibody or antigen-binding fragment thereof which specifically binds to CoV-S neutralizes, blocks or inhibits coronavirus infectivity or coronavirus proliferation, optionally wherein the coronavirus is SARS-CoV or SARS-CoV-2.

In certain embodiments, the method may further detect whether the antibody or antigen-binding antibody fragment thereof which specifically binds to the CoV-S binds to other coronaviruses, optionally selected from the group consisting of MERS-CoV, HCoV-HKU1, HCoV-OC43, HCoV-229E, and HCoV-NL63.

In any of such detection methods, the method may further comprise determining the sequence of the antibody or antigen-binding antibody fragment thereof may be determined.

In some embodiments these sequences may be affinity-matured or mutated to enhance binding affinity and/or potentially increase specificity to a particular CoV-S.

The present disclosure further provides compositions comprising: (a) at least one antibody or antigen-binding antibody fragment of the present disclosure; and (b) a pharmaceutically acceptable carrier or excipient.

The present disclosure further provides methods of determining whether a subject has been infected with SARS-CoV or SARS-CoV-2 or another coronavirus by detecting whether a biological sample from the subject may comprise SARS-CoV-S protein or SARS-CoV-S-2 protein or another coronavirus S protein homologous thereto based on its immunoreaction with at least one antibody or antigen-binding antibody fragment disclosed herein. The sample may optionally be blood, plasma, lymph, mucus, urine, and/or feces. Optionally, the SARS-CoV S may comprise the amino acid sequence of SEQ ID NO: 1 (SARS-CoV-S, 1288 amino acids, Accession #PDB: 6VSB_B), Alternatively, the SARS-CoV-2 may comprise the amino acid sequence of SEQ ID NO: 5 (SARS-CoV-2-S, 1273 amino acids, GenBank: QHD43416.1).

Such determination methods optionally may comprise an ELISA or radioimmunoassay.

In such determination methods, the subject optionally may be human, a companion animal (e.g., a dog or cat), an agricultural animal, e.g., animals used in meat production, or may comprise an animal in a zoo, e.g., a tiger or lion.

In such determination methods, the samples optionally may be collected at different times from the subject and the presence or absence or the level of SARS-CoV-S or SARS-CoV-S-2 or another coronavirus S protein homologous thereto may be detected in order to assess whether the subject has recovered. Here, the SARS-CoV S may comprise the amino acid sequence of SEQ ID NO: 1 (SARS-CoV-S, 1288 amino acids, Accession #PDB: 6VSB_B), and optionally the SARS-CoV-2 may comprise the amino acid sequence of SEQ ID NO: 5 (SARS-CoV-2-S, 1273 amino acids, GenBank: QHD43416.1).

The present disclosure further provides methods of inducing an immune response against SARS-CoV or SARS-CoV-2 or another coronavirus, which may be selected from MERS-CoV, HCoV-HKU1, HCoV-OC43, HCoV-229E, and HCoV-NL63, in a subject in need thereof.

In some embodiments, the methods may comprise administering at least one antibody or antigen-binding antibody fragment of the present disclosure.

In some embodiments, the methods may comprise administering a cocktail of different antibodies or antigen-binding antibody fragments of the present disclosure, e.g., which bind to the same or different epitopes on the same or different CoV-Ss.

In certain embodiments, the immune response elicits immunoprotection, optionally prolonged, against at least one coronavirus, optionally SARS-CoV or SARS-CoV-2, further optionally against another coronavirus.

The present disclosure further provides methods of inhibiting or blocking infection of susceptible cells by SARS-CoV or SARS-CoV-2 or another coronavirus, such as MERS-CoV, HCoV-HKU1, HCoV-OC43, HCoV-229E, and HCoV-NL63, in a subject in need thereof.

In some embodiments, the method may comprise administering at least one antibody or antigen-binding antibody fragment, of the present disclosure, e.g., a cocktail as above-described.

The present disclosure further provides methods of treating infection by SARS-CoV or SARS-CoV-2 or another coronavirus optionally such as MERS-CoV, HCoV-HKU1, HCoV-OC43, HCoV-229E, and HCoV-NL63, or treating a condition, symptom, disease, or disorder associated with said infection in a subject in need thereof.

In some embodiments, the method may comprise administering to the subject a therapeutically effective amount of at least one antibody or antigen-binding antibody fragment, an ADC or a CAR, of the present disclosure, e.g., a cocktail as above-described.

In some embodiments, the condition, symptom, disease, or disorder comprises at least one of bronchitis, pneumonia, respiratory failure, acute respiratory failure, organ failure, multi-organ system failure, pediatric inflammatory multisystem syndrome, acute respiratory distress syndrome, blood clot, a cardiac condition, myocardial injury, myocarditis, heart failure, cardiac arrest, acute myocardial infarction, dysrhythmia, venous thromboembolism, post-intensive care syndrome, shock, anaphylactic shock, cytokine release syndrome, septic shock, disseminated intravascular coagulation, ischemic stroke, intracerebral hemorrhage, microangiopathic thrombosis, psychosis, seizure, nonconvulsive status epilepticus, traumatic brain injury, stroke, anoxic brain injury, encephalitis, posterior reversible leukoencephalopathy, necrotizing encephalopathy, post-infectious encephalitis, autoimmune mediated encephalitis, acute disseminated encephalomyelitis, acute kidney injury, acute liver injury, pancreatic injury, immune thrombocytopenia, subacute thyroiditis, a gastrointestinal complication, aspergillosis, increased susceptibility to infection with another virus or bacteria, and/or a pregnancy-related complication.

The present disclosure also provides methods of preventing infection by SARS-CoV or SARS-CoV-2 or another coronavirus optionally selected from the group consisting of MERS-CoV, HCoV-HKU1, HCoV-OC43, HCoV-229E, and HCoV-NL63 in a subject in need thereof.

In some embodiments, the method may comprise administering to the subject a prophylactically effective amount of at least one antibody or antigen-binding antibody fragment, an ADC or a CAR, of the present disclosure, e.g., a cocktail as above-described.

The present disclosure also provides methods of preventing the need for a subject infected with SARS-CoV or SARS-CoV-2 or another coronavirus optionally selected from the group consisting of MERS-CoV, HCoV-HKU1, HCoV-OC43, HCoV-229E, and HCoV-NL63 to be placed on a ventilator, or reducing the time that a subject infected with SARS-CoV or SARS-CoV-2 or another coronavirus optionally selected from the group consisting of MERS-CoV, HCoV-HKU1, HCoV-OC43, HCoV-229E, and HCoV-NL63 is on a ventilator.

In some embodiments, the method may comprise administering to the subject a prophylactically or therapeutically effective amount of at least one antibody or antigen-binding antibody fragment, an ADC or a CAR, of the present disclosure, e.g., a cocktail as above-described.

The present disclosure provides methods of preventing the onset of pneumonia in a subject infected SARS-CoV or SARS-CoV-2 or another coronavirus optionally selected from the group consisting of MERS-CoV, HCoV-HKU1, HCoV-OC43, HCoV-229E, and HCoV-NL63, or treating pneumonia and/or the symptoms of pneumonia in a subject for a subject infected SARS-CoV or SARS-CoV-2 or another coronavirus optionally selected from the group consisting of MERS-CoV, HCoV-HKU1, HCoV-OC43, HCoV-229E, and HCoV-NL63.

In some embodiments, the method may comprise administering to the subject a prophylactically or therapeutically effective amount of at least one antibody or antigen-binding antibody fragment, an ADC or a CAR, of the present disclosure, e.g., a cocktail as above-described.

In any of such methods, the subject optionally may be human or may comprise a companion animal, agricultural animal or animal in a zoo.

Optionally the subject may have at least one risk factor which renders them more prone to a poor clinical outcome.

In certain embodiments, wherein the risk factors may comprise one or more of (i) advanced age such as over 55, 60 or 65 years old, (ii) diabetes, (iii) a chronic respiratory condition such as asthma, cystic fibrosis, another fibrotic condition, or COPD, (iv) obesity, (iv) hypertension, (v) a cardiac or cardiovascular condition, such as heart defects or abnormalities, (vi) a chronic inflammatory or autoimmune condition, e.g., lupus or multiple sclerosis, and (vii) an immunocompromised status which optionally may be caused by cancer, chemotherapy, smoking, bone marrow or organ transplantation, immune deficiencies, poorly controlled HIV infection or AIDS, or prolonged use of corticosteroids or other immunosuppressive medications.

In certain embodiments, the subject may further be treated with at least one other drug. In certain embodiments, the method further comprises administering to the subject at least one other drug. Optionally, such one other drug may be: (i) an antiviral drug, optionally, remdesivir, favipiravir, darunavir, nelfinavir, saquinavir, lopinavir, or ritonavir; (ii) an antihelminth drug, optionally ivermectin; (iii) an antiparasitic drug, optionally hydroxychloroquine, chloroquine, or atovaquone; (iv) antibacterial vaccine, optionally the tuberculosis vaccine BCG; (v) an anti-inflammatory drug, optionally a steroid such as ciclesonide, a TNF inhibitor (e.g., adalimumab), a TNF receptor inhibitor (e.g., etanercept), an IL-6 inhibitor (e.g., clazakizumab), an IL-6 receptor inhibitor (e.g., tocilizumab), or metamizole; (vi) an antihistamine drug, optionally bepotastine; (vii) an ACE inhibitor, optionally moexipril; and/or (viii) a drug that inhibits priming of CoV-S, optionally a serine protease inhibitor, further optionally nafamostat.

In certain embodiments, the subject may further be treated with: (I) an antiviral agent, optionally, remdesivir, favipiravir, darunavir, nelfinavir, saquinavir, lopinavir, or ritonavir; and (II) at least one other drug. In certain embodiments, the method may further comprise administering to the subject (I) an antiviral agent, optionally, remdesivir, favipiravir, darunavir, nelfinavir, saquinavir, lopinavir, or ritonavir; and (II) at least one other drug. Optionally, the at least one other drug may be (i) an antihelminth drug, further optionally ivermectin; (ii) an antiparasitic drug, optionally hydroxychloroquine, chloroquine, or atovaquone; (iii) an antibacterial vaccine, which is optionally the tuberculosis vaccine BCG; or (iv) an anti-inflammatory drug, optionally a steroid such as ciclesonide, a TNF inhibitor (e.g., adalimumab), a TNF receptor inhibitor (e.g., etanercept), an IL-6 inhibitor (e.g., clazakizumab), an IL-6 receptor inhibitor (e.g., tocilizumab), or metamizole; (v) an antihistamine drug, optionally bepotastine; (vi) an ACE inhibitor, optionally moexipril; and/or (vii) a drug that inhibits priming of CoV-S, which is optionally a serine protease inhibitor such as nafamostat.

In some embodiments, anti-CoV-S antibodies or antigen-binding antibody fragments of the present disclosure may be characterized by having a certain VH CDR3 sequences or having a VH CDR3 sequences that are similar to a certain VH CDR3.

In some embodiments, antibodies or antigen-binding antibody fragments of the present may comprise: (i) a VH and a VL or (ii) a VH, and the VH may comprise a CDR3 having the amino acid sequence of SEQ ID NO: 2108, 21708, 22208, 22408, 22608, or 22708.

In certain embodiments, antibodies or antigen-binding antibody fragments of the present may comprise a VH and a VL, and the VH may additionally comprise a CDR1 and a CDR3 having the amino acid sequence of SEQ ID NOS: 2104 and 2108, respectively, SEQ ID NOS: 21704 and 21708, respectively, SEQ ID NOS: 22204 and 22208, respectively, SEQ ID NOS: 22404 and 22408, respectively, SEQ ID NOS: 22604 and 22608, respectively, or SEQ ID NOS: 22704 and 22708, respectively.

In further embodiments, antibody or antigen-binding antibody fragment of the present may comprise (I) a VH and a VL or (II) a VH, and the amino acid sequence of the VH CDR3 may be: (i) identical to the amino acid sequence of SEQ ID NO: 1508 or differ from SEQ ID NO: 1508 by 1, 2, or 3 amino acids; (ii) identical to the amino acid sequence of SEQ ID NO: 1308 or differ from SEQ ID NO: 1308 by 1, 2, or 3 amino acids; (iii) identical to the amino acid sequence of SEQ ID NO: 808 or differ from SEQ ID NO: 808 by 1, 2, or 3 amino acids; (iv) identical to the amino acid sequence of SEQ ID NO: 108 or differ from SEQ ID NO: 108 by 1, 2, or 3 amino acids; (v) identical to the amino acid sequence of SEQ ID NO: 2108 or differ from SEQ ID NO: 2108 by 1, 2, or 3 amino acids; (vi) identical to the amino acid sequence of SEQ ID NO: 108 or differs from SEQ ID NO: 108 by 1, 2, or 3 amino acids; (vii) identical to the amino acid sequence of SEQ ID NO: 208 or differs from SEQ ID NO: 208 by 1, 2, or 3 amino acids; (viii) identical to the amino acid sequence of SEQ ID NO: 308 or differs from SEQ ID NO: 308 by 1, 2, or 3 amino acids; (ix) identical to the amino acid sequence of SEQ ID NO: 8608 or differs from SEQ ID NO: 8608 by 1, 2, or 3 amino acids; (x) identical to the amino acid sequence of SEQ ID NO: 12308 or differs from SEQ ID NO: 12308 by 1, 2, or 3 amino acids; (xi) identical to the amino acid sequence of SEQ ID NO: 13008 or differs from SEQ ID NO: 13008 by 1, 2, or 3 amino acids; (xii) identical to the amino acid sequence of SEQ ID NO: 14008 or differs from SEQ ID NO: 14008 by 1, 2, or 3 amino acids; (xiii) identical to the amino acid sequence of SEQ ID NO: 16208 or differs from SEQ ID NO: 16208 by 1, 2, or 3 amino acids; (xiv) identical to the amino acid sequence of SEQ ID NO: 17508 or differs from SEQ ID NO: 17508 by 1, 2, or 3 amino acids; (xv) identical to the amino acid sequence of SEQ ID NO: 21708 or differs from SEQ ID NO: 21708 by 1, 2, or 3 amino acids; (xvi) identical to the amino acid sequence of SEQ ID NO: 22208 or differs from SEQ ID NO: 22208 by 1, 2, or 3 amino acids; (xvii) identical to the amino acid sequence of SEQ ID NO: 22408 or differs from SEQ ID NO: 22408 by 1, 2, or 3 amino acids; (xviii) identical to the amino acid sequence of SEQ ID NO: 22608 or differs from SEQ ID NO: 22608 by 1, 2, or 3 amino acids; or (xix) identical to the amino acid sequence of SEQ ID NO: 22708 or differs from SEQ ID NO: 22708 by 1, 2, or 3 amino acids; or (xx) identical to the amino acid sequence of SEQ ID NO: 23008 or differs from SEQ ID NO: 23008 by 1, 2, or 3 amino acids.

In one embodiment, the anti-CoV-S antibodies or antigen-binding antibody fragment may comprise the VH CDR1, VH CDR2, VH CDR3, VL CDR1, VL CDR2, and VL CDR3, respectively, of an anti-CoV-S antibody selected from the group consisting of ADI-55688, ADI-55689, ADI-55690, ADI-55951, ADI-55993, ADI-56000, ADI-56010, ADI-56032, ADI-56046, ADI-57983 (with primer mutation), ADI-57978 (with primer mutation), ADI-56868 (with primer mutation), ADI-56443 (with primer mutation), ADI-56479 (with primer mutation), ADI-57983, ADI-57978, ADI-56868, ADI-56443, and ADI-56479, optionally of an anti-CoV-S antibody selected from the group consisting of ADI-57983 (with primer mutation), ADI-57978 (with primer mutation), ADI-56868 (with primer mutation), ADI-56443 (with primer mutation), ADI-56479 (with primer mutation), ADI-58120, ADI-58121, ADI-58122, ADI-58123, ADI-58124, ADI-58125, ADI-58126, ADI-58127, ADI-58128, ADI-58129, ADI-58130, ADI-58131, ADI-58130_LCN30cQ, and ADI-59988, and further optionally of an anti-CoV-S antibody selected from the group consisting of ADI-57983 (with primer mutation), ADI-57978 (with primer mutation), ADI-56868 (with primer mutation), ADI-58120, ADI-58121, ADI-58122, ADI-58123, ADI-58124, ADI-58125, ADI-58126, ADI-58127, ADI-58128, ADI-58129, ADI-58130, ADI-58131, ADI-58130_LCN30cQ, and ADI-59988.

In some embodiments, the antibody or antigen-binding antibody fragment may specifically compete with another antibody or antigen-binding antibody fragment that may comprise the VH CDR1, VH CDR2, VH CDR3, VL CDR1, VL CDR2, and VL CDR3, respectively, of an anti-CoV-S antibody selected from the group consisting of ADI-55688, ADI-55689, ADI-55690, ADI-55951, ADI-55993, ADI-56000, ADI-56010, ADI-56032, ADI-56046, ADI-57983 (with primer mutation), ADI-57978 (with primer mutation), ADI-56868 (with primer mutation), ADI-56443 (with primer mutation), ADI-56479 (with primer mutation), ADI-58120, ADI-58121, ADI-58122, ADI-58123, ADI-58124, ADI-58125, ADI-58126, ADI-58127, ADI-58128, ADI-58129, ADI-58130, ADI-58131, ADI-58130_LCN30cQ, or ADI-59988, and preferably of ADI-57983 (with primer mutation), ADI-57978 (with primer mutation), ADI-56868 (with primer mutation), ADI-56443 (with primer mutation), ADI-56479 (with primer mutation), ADI-58120, ADI-58121, ADI-58122, ADI-58123, ADI-58124, ADI-58125, ADI-58126, ADI-58127, ADI-58128, ADI-58129, ADI-58130, ADI-58131, ADI-58130_LCN30cQ, or ADI-59988, optionally of ADI-57983 (with primer mutation), ADI-57978 (with primer mutation), ADI-56868 (with primer mutation), ADI-58120, ADI-58121, ADI-58122, ADI-58123, ADI-58124, ADI-58125, ADI-58126, ADI-58127, ADI-58128, ADI-58129, ADI-58130, ADI-58131, ADI-58130_LCN30cQ, and ADI-59988.

In certain embodiments, antibody or antigen-binding antibody fragment of the present disclosure may comprise an Fc region. The Fc region may comprise a wild type sequence or a variant sequence and optionally may comprise an amino acid sequence of SEQ ID NOs: 11, 12, 13, 14, 15, 16, or 17.

In certain embodiments, the isolated antibody or antigen-binding antibody fragment may bind to the S1 subunit of SARS-CoV-S or of SARS-CoV-2-S.

In certain embodiments, the isolated antibody or antigen-binding antibody fragment may bind to the receptor binding domain (RBD) or the N-terminal domain (NTD) of SARS-CoV-S or of SARS-CoV-2-S.

In certain embodiments, the isolated antibody or antigen-binding antibody fragment may bind to the ACE2-binding motif of SARS-CoV-S or of SARS-CoV-2-S and optionally further binds to the epitope of the antibody CR3022.

In further embodiments, the isolated antibody or antigen-binding antibody fragment may compete with ACE2.

In further embodiments, the isolated antibody or antigen-binding antibody fragment may compete with: (i) ACE2 and the antibody CR3022; or (ii) ACE2 but not the antibody CR3022. In certain embodiments, the isolated antibody or antigen-binding antibody fragment (a) may bind to the S protein of SARS-CoV and/or of SARS-CoV-2; and (b) may not bind to any of the S proteins of HCoV-229E, HCoV-HKU1, HCoV-NL63, and HCoV-0K43.

In certain embodiments, the isolated antibody or antigen-binding antibody fragment may (a) bind to the S protein of SARS-CoV and/or of SARS-CoV-2; and also (b) bind to the S protein of at least one of HCoV-229E, HCoV-HKU1, HCoV-NL63, and HCoV-0K43.

In further embodiments, the isolated antibody or antigen-binding antibody fragment may neutralize SARS-CoV and/or SARS-CoV-2.

In further embodiments, the isolated antibody or antigen-binding antibody fragment may neutralize SARS-CoV and/or SARS-CoV-2 at 100 nM in vitro.

In further embodiments, the isolated antibody or antigen-binding antibody fragment may neutralize SARS-CoV and/or SARS-CoV-2 at: (i) an IC50 of about 100 nM or lower, of about 50 nM or lower, of about 20 nM or lower, of about 10 nM or lower, of about 5 nM or lower, of about 2 nM or lower, of about 1 nM or lower, of about 500 pM or lower, of about 200 pM or lower, of about 100 pM or lower, of about 50 pM or lower, of about 20 pM or lower, of about 10 pM or lower, of about 5 pM or lower, of about 2 pM or lower, or of about 1 pM or lower; and/or (ii) an IC50 of about 500 ng/mL or lower, of about 200 ng/mL or lower, of about 100 ng/mL or lower, of about 50 ng/mL or lower, of about 20 ng/mL or lower, of about 10 ng/mL or lower, of about 20 ng/mL or lower, of about 10 mg/mL or lower, of about 5 ng/mL or lower, of about 2 ng/mL or lower, or of about 1 ng/mL or lower, in vitro, optionally as measured by any of the neutralization assays described in the Examples herein.

In further embodiments, the isolated antibody or antigen-binding antibody fragment may bind to CoV-S (S protein of any CoV, such as but not limited to SARS-CoV-S and/or SARS-CoV-2-S) with a KD value of: (i) 100 nM or lower; (ii) 10 nM or lower; (iii) 1 nM or lower; (iv) 100 pM or lower; (v) 10 pM or lower; (vi) 1 pM or lower; or (vii) 0.1 pM or lower.

In some embodiments, the antibody, or antigen-binding fragment thereof, is administered intravenously. In other embodiments, the antibody, or antigen-binding fragment thereof, is administered intramuscularly.

In some embodiments, the antibody, or antigen-binding fragment thereof, is administered at a dose of about 100 mg to about 2000 mg, about 200 mg to about 1500 mg, about 300 mg to about 600 mg, about 500 mg to about 1200 mg, or about 300 mg to about 1200 mg. In some embodiments, the antibody, or antigen-binding fragment thereof, is administered at a dose of about 200 mg, about 300 mg, about 400 mg, about 500 mg, about 600 mg, about 700 mg, about 800 mg, about 900 mg, about 1000 mg about 1100 mg, about 1200 mg, about 1300 mg, about 1400 mg, about 1500 mg, about 1600 mg, about 1700 mg, about 1800 mg, about 1900 mg or about 2000 mg.

In some embodiments, the antibody, or antigen-binding fragment thereof, is administered at a dose of about 300 mg intramuscularly, about 500 mg intravenously, about 600 mg intramuscularly, or about 1200 mg intravenously.

In one embodiment, the antibody, or antigen-binding fragment thereof, is administered once. In one embodiment, the antibody, or antigen-binding fragment thereof, is administered weekly. In another embodiment, the antibody, or antigen-binding fragment thereof, is administered daily, weekly, every two weeks, monthly, or every two months. In one embodiment, the antibody, or antigen-binding fragment thereof, is administered weekly for about four weeks, once weekly for about a month, weekly for about 5 weeks, weekly for about 6 weeks, weekly for about 7 weeks, or weekly for about two months.

In one aspect, the present disclosure also relates to kits comprising: (a) at least one isolated antibody or antigen-binding antibody fragment disclosed herein; and (b) an instruction for using the antibody or antigen-binding antibody fragment.

In some embodiments, the kit may be for use in: (i) determining whether a CoV is present in a subject; (ii) diagnosing whether a subject has CoV infection; (iii) predicting whether a CoV vaccine will elicit a protective immune response; or (iv) predicting whether a CoV vaccine will elicit a neutralizing antibody response.

In one aspect, provided herein are methods of predicting the in vivo efficacy of an anti-CoV-S antibody or antigen-binding antibody fragment in preventing or treating CoV infection.

In some embodiments, the method may comprise: (a) providing at least one first test subject and at least one second subject or a cell sample derived from at least one first test subject and at least one second subject; (b) administering the antibody or antigen-binding antibody fragment to said at least one first test subject and said at least one second subject or contacting a cell sample from said first and second subject with the antibody or antigen-binding antibody fragment; (c) infecting said at least one first test subject and said at least one second subject with CoV or pseudo CoV or a cell sample obtained from said at least one first test subject and said at least one second subject with CoV or pseudo CoV; (d) determining whether administration of the antibody or anti-gen-binding antibody fragment in (b) results in one or more of the following compared to a suitable control: (I) reduction in a CoV-associated symptom; (II) reduction in the CoV viremia; (III) increase in the survival; (IV) increase in the body weight; or (V) reduced infection of cells or virus proliferation in cells of the tested cell sample compared to a control cell sample not contacted with the antibody or antigen-binding antibody fragment.

In some embodiments, the method may comprise: (a) providing at least one first cell sample and at least one second cell sample; (b) contacting the at least one first cell sample with the antibody or antigen-binding antibody fragment; (c) infecting said at least one first cell sample and at least one second cell sample with CoV or pseudo CoV; (d) determining whether the antibody or antigen-binding antibody fragment results in one or more of the following compared to a suitable control: (I) increase in the cell survival; (II) reduced infection of cells; (III) reduced virus proliferation; (IV) reduced cell stress or death markers; or (V) reduced inflammatory cytokines, in cells of the tested cell sample compared to a control cell sample not contacted with the antibody or antigen-binding antibody fragment.

In some embodiments, the method may comprise: (a) providing at least one first test subject and at least one second subject or a cell sample derived from at least one first test subject and at least one second subject; (b) infecting said at least one first test subject and said at least one second subject with CoV or pseudo CoV or a cell sample derived from at least one first test subject and at least one second subject; (c) administering the antibody or antigen-binding antibody fragment to said at least one second subject or contacting a cell sample derived from at least one first test subject and at least one second subject with the antibody or antigen-binding antibody fragment; (d) determining whether administration of the antibody or antigen-binding antibody fragment in (c) results in one or more of the following: (I) reduction in a CoV-associated symptom; (II) reduction in the CoV viremia; (III) increase in the survival; (IV) increase in the body weight; or (V) reduced infection of cells or virus proliferation in cells in the tested cell sample compared to a control cell sample not contacted with the antibody or antigen-binding antibody fragment.

In some embodiments, the method may comprise: (a) providing at least one first cell sample and at least one second cell sample; (b) infecting said at least one first cell sample and at least one second cell sample with CoV or pseudo CoV; (c) contacting the at least one first cell sample with the antibody or antigen-binding antibody fragment; (d) determining whether the antibody or antigen-binding antibody fragment results in one or more of the following compared to a suitable control: (I) increase in the cell survival; (II) reduced infection of cells; (III) reduced virus proliferation; (IV) reduced cell stress or death markers; or (V) reduced inflammatory cytokines, in cells of the tested cell sample compared to a control cell sample not contacted with the antibody or antigen-binding antibody fragment.

In one aspect, provided herein are methods of screening for an antibody or antigen-binding antibody fragment that binds to a CoV or CoV-S, the method comprising whether an antibody or antigen-binding antibody fragment comprising 1, 2, 3, 4, 5, or 6 CDRs of any of the antibodies disclosed herein may comprise one or more of the following features: (i) binds to the S protein of a CoV; (ii) binds to the S1 subunit of CoV-S; (iii) binds to the RBD of CoV-S; (iv) binds to the NTD of CoV-S; (v) binds to the ACE2-binding motif of CoV-S; (vi) competes with ACE2; (vii) competes with the antibody CR3022; (viii) neutralizes one or more of SARS-CoV, SARS-CoV-2, MERS-CoV, HCoV-229E, HCoV-HKU1, HCoV-NL63, or HCoV-0K43 or variants thereof; (ix) neutralizes a pseudovirus of one or more of SARS-CoV, SARS-CoV-2, MERS-CoV, HCoV-229E, HCoV-HKU1, HCoV-NL63, or HCoV-0K43 or variants thereof; (x) results in reduced infection of cells or virus proliferation in cells in a susceptible tested cell sample compared to a control cell sample not contacted with the antibody or antigen-binding antibody fragment; or (xi) prevents or treats CoV infection in vivo. During the screening, any of the antibodies disclosed herein and/or an antibody comprising one or more of the CDRs of the antibodies disclosed herein may be used as a candidate antibody or a control antibody.

In one aspect, the present disclosure also relates to compositions comprising at least one affinity-matured first anti-CoV-S antibody or antigen-binding antibody fragment and a pharmaceutically acceptable carrier or excipient.

In some embodiments, the at least one first antibody or antigen-binding antibody fragment may comprise: a VH comprising a VH CDR1, a VH CDR2, a VH CDR3; and a VL, comprising a VL CDR1 a VL CDR2, a VL CDR3, and the amino acid sequences of said VH CDR1, said VH CDR2, said VH CDR3, said VL CDR1, said VL CDR2, and said VL CDR3 are identical to the amino acid sequences of the VH CDR1, VH CDR2, VH CDR3, VL CDR1, VL CDR2, and VL CDR3, respectively, of an anti-CoV-S antibody selected from the group consisting of ADI-58120, ADI-58121, ADI-58122, ADI-58123, ADI-58124, ADI-58125, ADI-58126, ADI-58127, ADI-58128, ADI-58129, ADI-58130, ADI-58131, ADI-58130_LCN30cQ, and ADI-59988.

In particular embodiments, the VH and VL of said first antibody or antigen-binding antibody fragment may be the VH and VL, respectively, of an anti-CoV-S antibody selected from the group consisting of ADI-58120, ADI-58122, ADI-58124, ADI-58126, ADI-58128, ADI-58130, ADI-58131, and ADI-58130_LCN30cQ.

In some embodiments, the first antibody or antigen-binding antibody fragment may comprise an Fc region, optionally wherein the Fc region may comprise an amino acid sequence of SEQ ID NOs: 11, 12, 13, 14, 15, 16, or 17.

In one embodiment, the HC and LC of the first antibody or antigen-binding antibody fragment are the HC and LC, respectively, of an anti-CoV-S antibody selected from the group consisting of ADI-58120, ADI-58121, ADI-58122, ADI-58123, ADI-58124, ADI-58125, ADI-58126, ADI-58127, ADI-58128, ADI-58129, ADI-58130, ADI-58131, ADI-58130_LCN30cQ, and ADI-59988.

In certain embodiments, the composition may further comprise at least one second antibody or antigen-binding antibody fragment comprising a VH comprising a VH CDR1, a VH CDR2, a VH CDR3 and a VL, comprising a VL CDR1 a VL CDR2, a VL CDR3. In particular embodiments, the amino acid sequences of said VH CDR1, said VH CDR2, said VH CDR3, said VL CDR1, said VL CDR2, and said VL CDR3 may be identical to the amino acid sequences of the VH CDR1, VH CDR2, VH CDR3, VL CDR1, VL CDR2, and VL CDR3, respectively, of an anti-CoV-S antibody selected from the group consisting of ADI-58120, ADI-58121, ADI-58122, ADI-58123, ADI-58124, ADI-58125, ADI-58126, ADI-58127, ADI-58128, ADI-58129, ADI-58130, ADI-58131, ADI-58130_LCN30cQ, and ADI-59988.

In some embodiments, the second antibody or antigen-binding antibody fragment may comprise an Fc region, optionally wherein the Fc region may comprise an amino acid sequence of SEQ ID NOs: 11, 12, 13, 14, 15, 16, or 17.

In particular embodiments, the antibody or antigen-binding antibody fragment according to the present disclosure may comprise:
(217) a HC comprising the amino acid sequence of SEQ ID NO: 21701 and a LC comprising the amino acid sequence of SEQ ID NO: 21711;
(218) a HC comprising the amino acid sequence of SEQ ID NO: 21801 and a LC comprising the amino acid sequence of SEQ ID NO: 21811;
(219) a HC comprising the amino acid sequence of SEQ ID NO: 21901 and a LC comprising the amino acid sequence of SEQ ID NO: 21911;
(220) a HC comprising the amino acid sequence of SEQ ID NO: 22001 and a LC comprising the amino acid sequence of SEQ ID NO: 22011;
(221) a HC comprising the amino acid sequence of SEQ ID NO: 22101 and a LC comprising the amino acid sequence of SEQ ID NO: 22111;
(222) a HC comprising the amino acid sequence of SEQ ID NO: 22201 and a LC comprising the amino acid sequence of SEQ ID NO: 22211;
(223) a HC comprising the amino acid sequence of SEQ ID NO: 22301 and a LC comprising the amino acid sequence of SEQ ID NO: 22311;
(224) a HC comprising the amino acid sequence of SEQ ID NO: 22401 and a LC comprising the amino acid sequence of SEQ ID NO: 22411;
(225) a HC comprising the amino acid sequence of SEQ ID NO: 22501 and a LC comprising the amino acid sequence of SEQ ID NO: 22511;
(226) a HC comprising the amino acid sequence of SEQ ID NO: 22601 and a LC comprising the amino acid sequence of SEQ ID NO: 22611;
(227) a HC comprising the amino acid sequence of SEQ ID NO: 22701 and a LC comprising the amino acid sequence of SEQ ID NO: 22711;
(228) a HC comprising the amino acid sequence of SEQ ID NO: 22801 and a LC comprising the amino acid sequence of SEQ ID NO: 22811;
(229) a HC comprising the amino acid sequence of SEQ ID NO: 22901 and a LC comprising the amino acid sequence of SEQ ID NO: 22911;
(230) a HC comprising the amino acid sequence of SEQ ID NO: 23001 and a LC comprising the amino acid sequence of SEQ ID NO: 23011; or
(231) a HC comprising the amino acid sequence of SEQ ID NO: 23101 and a LC comprising the amino acid sequence of SEQ ID NO: 23111.

In further embodiments, the composition according to the present disclosure may comprise: (A) at least one first antibody or antigen-binding antibody fragment selected from the group consisting of the antibodies or antigen-binding antibody fragments comprising the HC and LC combination of (217)-(231) as described above; and (B) a pharmaceutically acceptable carrier or excipient.

In yet further embodiments, the composition may additionally comprise at least one second antibody or antigen-binding antibody fragment selected from the group consisting of the antibodies or antigen-binding antibody fragments comprising the HC and LC combination of (217)-(231) as described above.

Additionally, the present disclosure further encompasses isolated antibodies and antigen-binding antibody fragments thereof, which competes for binding with any one or more of the anti-CoV antibodies or antigen-binding antibody fragments thereof as described herein.

The present disclosure also encompasses isolated antibodies or antigen-binding antibody fragments thereof, which bind the same epitope as any one or more of the anti-CoV antibodies or antigen-binding antibody fragments thereof as described herein.

The present disclosure further encompasses affinity matured variants of any one or more of the anti-CoV antibodies or antigen-binding antibody fragments thereof as described herein.

In one aspect, disclosed herein is a method of treating a coronavirus infection by SARS-CoV, SARS-CoV-2, and/or another coronavirus optionally selected from the group consisting of MERS-CoV, HCoV-HKU1, HCoV-OC43, HCoV-229E, and HCoV-NL63 in a subject in need thereof, the method comprising administering to the subject a therapeutically effective amount of an antibody, or antigen-binding antibody fragment thereof, which binds the same epitope as ADI-58125, and/or which competes for binding with ADI-58125.

In one aspect, disclosed herein is a method of decreasing the risk of mortality, hospitalization, mechanical ventilation, or a combination thereof in a patient infected by SARS-CoV, ARS-CoV-2, and/or another coronavirus optionally selected from the group consisting of MERS-CoV, HCoV-HKU1, HCoV-OC43, HCoV-229E, and HCoV-NL63, the method comprising administering to the subject a therapeutically effective amount of an isolated antibody, or antigen-binding antibody fragment thereof, which binds the same epitope as ADI-58125, and/or which competes for binding with ADI-58125.

In another aspect, disclosed herein is a method of preventing infection of a subject by SARS-CoV, SARS-CoV-2, and/or another coronavirus optionally selected from the group consisting of MERS-CoV, HCoV-HKU1, HCoV-OC43, HCoV-229E, and HCoV-NL63, the method comprising administering to the subject a therapeutically effective amount of an isolated antibody, or antigen-binding antibody fragment thereof, which binds the same epitope as ADI-58125, and/or which competes for binding with ADI-58125.

In one embodiment, the antibody, or antigen-binding fragment thereof, of FIG. 1, FIG. 2 or FIG. 36 is ADI-55688. In one embodiment, the antibody, or antigen-binding fragment thereof, of FIG. 1, FIG. 2 or FIG. 36 is ADI-55689. In one embodiment, the antibody, or antigen-binding fragment thereof, of FIG. 1, FIG. 2 or FIG. 36 is ADI-55690. In one embodiment, the antibody, or antigen-binding fragment thereof, of FIG. 1, FIG. 2 or FIG. 36 is ADI-55691. In one embodiment, the antibody, or antigen-binding fragment thereof, of FIG. 1, FIG. 2 or FIG. 36 is ADI-55692. In one embodiment, the antibody, or antigen-binding fragment thereof, of FIG. 1, FIG. 2 or FIG. 36 is ADI-55693. In one embodiment, the antibody, or antigen-binding fragment thereof, of FIG. 1, FIG. 2 or FIG. 36 is ADI-55694. In one embodiment, the antibody, or antigen-binding fragment thereof, of FIG. 1, FIG. 2 or FIG. 36 is ADI-55695. In one embodiment, the antibody, or antigen-binding fragment thereof, of FIG. 1, FIG. 2 or FIG. 36 is ADI-55696. In one embodiment, the antibody, or antigen-binding fragment thereof, of FIG. 1, FIG. 2 or FIG. 36 is ADI-55697. In one embodiment, the antibody, or antigen-binding fragment thereof, of FIG. 1, FIG. 2 or FIG. 36 is ADI-55698. In one embodiment, the antibody, or antigen-binding fragment thereof, of FIG. 1, FIG. 2 or FIG. 36 is ADI-55699. In one embodiment, the antibody, or antigen-binding fragment thereof, of FIG. 1, FIG. 2 or FIG. 36 is ADI-55700. In one embodiment, the antibody, or antigen-binding fragment thereof, of FIG. 1, FIG. 2 or FIG. 36 is ADI-55701. In one embodiment, the antibody, or antigen-binding fragment thereof, of FIG. 1, FIG. 2 or FIG. 36 is ADI-55702. In one embodiment, the antibody, or antigen-binding fragment thereof, of FIG. 1, FIG. 2 or FIG. 36 is ADI-55703. In one embodiment, the antibody, or antigen-binding fragment thereof, of FIG. 1, FIG. 2 or FIG. 36 is ADI-55704. In one embodiment, the antibody, or antigen-binding fragment thereof, of FIG. 1, FIG. 2 or FIG. 36 is ADI-55705. In one embodiment, the antibody, or antigen-binding fragment thereof, of FIG. 1, FIG. 2 or FIG. 36 is ADI-55706. In one embodiment, the antibody, or antigen-binding fragment thereof, of FIG. 1, FIG. 2 or FIG. 36 is ADI-55707. In one embodiment, the antibody, or antigen-binding fragment thereof, of FIG. 1, FIG. 2 or FIG. 36 is ADI-55708. In one embodiment, the antibody, or antigen-binding fragment thereof, of FIG. 1, FIG. 2 or FIG. 36 is ADI-55709. In one embodiment, the antibody, or antigen-binding fragment thereof, of FIG. 1, FIG. 2 or FIG. 36 is ADI-55710. In one embodiment, the antibody, or antigen-binding fragment thereof, of FIG. 1, FIG. 2 or FIG. 36 is ADI-55711. In one embodiment, the antibody, or antigen-binding fragment thereof, of FIG. 1, FIG. 2 or FIG. 36 is ADI-55712. In one embodiment, the antibody, or antigen-binding fragment thereof, of FIG. 1, FIG. 2 or FIG. 36 is ADI-55713. In one embodiment, the antibody, or antigen-binding fragment thereof, of FIG. 1, FIG. 2 or FIG. 36 is ADI-55714. In one embodiment, the antibody, or antigen-binding fragment thereof, of FIG. 1, FIG. 2 or FIG. 36 is ADI-55715. In one embodiment, the antibody, or antigen-binding fragment thereof, of FIG. 1, FIG. 2 or FIG. 36 is ADI-55716. In one embodiment, the antibody, or antigen-binding fragment thereof, of FIG. 1, FIG. 2 or FIG. 36 is ADI-55717. In one embodiment, the antibody, or antigen-binding fragment thereof, of FIG. 1, FIG. 2 or FIG. 36 is ADI-55718. In one embodiment, the antibody, or antigen-binding fragment thereof, of FIG. 1, FIG. 2 or FIG. 36 is ADI-55719. In one embodiment, the antibody, or antigen-binding fragment thereof, of FIG. 1, FIG. 2 or FIG. 36 is ADI-55721. In one embodiment, the antibody, or antigen-binding fragment thereof, of FIG. 1, FIG. 2 or FIG. 36 is ADI-55722. In one embodiment, the antibody, or antigen-binding fragment thereof, of FIG. 1, FIG. 2 or FIG. 36 is ADI-55723. In one embodiment, the antibody, or antigen-binding fragment thereof, of FIG. 1, FIG. 2 or FIG. 36 is ADI-55724. In one embodiment, the antibody, or antigen-binding fragment thereof, of FIG. 1, FIG. 2 or FIG. 36 is ADI-55725. In one embodiment, the antibody, or antigen-binding fragment thereof, of FIG. 1, FIG. 2 or FIG. 36 is ADI-55726. In one embodiment, the antibody, or antigen-binding fragment thereof, of FIG. 1, FIG. 2 or FIG. 36 is ADI-55727. In one embodiment, the antibody, or antigen-binding fragment thereof, of FIG. 1, FIG. 2 or FIG. 36 is ADI-55728. In one embodiment, the antibody, or antigen-binding fragment thereof, of FIG. 1, FIG. 2 or FIG. 36 is ADI-55729. In one embodiment, the antibody, or antigen-binding fragment thereof, of FIG. 1, FIG. 2 or FIG. 36 is ADI-55730. In one embodiment, the antibody, or antigen-binding fragment thereof, of FIG. 1, FIG. 2 or FIG. 36 is ADI-55731. In one embodiment, the antibody, or antigen-binding fragment thereof, of FIG. 1, FIG. 2 or FIG. 36 is ADI-55732. In one embodiment, the antibody, or antigen-binding fragment thereof, of FIG. 1, FIG. 2 or FIG. 36 is ADI-55733. In one embodiment, the antibody, or antigen-binding fragment thereof, of FIG. 1, FIG. 2 or FIG. 36 is ADI-55734. In one embodiment, the antibody, or antigen-binding fragment thereof, of FIG. 1, FIG. 2 or FIG. 36 is ADI-55735. In one embodiment, the antibody, or antigen-binding fragment thereof, of FIG. 1, FIG. 2 or FIG. 36 is ADI-55736. In one embodiment, the antibody, or antigen-binding fragment thereof, of FIG. 1, FIG. 2 or FIG. 36 is ADI-55737. In one embodiment, the antibody, or antigen-binding fragment thereof, of FIG. 1, FIG. 2 or FIG. 36 is ADI-55738. In one embodiment, the antibody, or antigen-binding fragment thereof, of FIG. 1, FIG. 2 or FIG. 36 is ADI-55739. In one embodiment, the antibody, or antigen-binding fragment thereof, of FIG. 1, FIG. 2 or FIG. 36 is ADI-55740. In one embodiment, the antibody, or antigen-binding fragment thereof, of FIG. 1, FIG. 2 or FIG. 36 is ADI-55741. In one embodiment, the antibody, or antigen-binding fragment thereof, of FIG. 1, FIG. 2 or FIG. 36 is ADI-55742. In one embodiment, the antibody, or antigen-binding fragment thereof, of FIG. 1, FIG. 2 or FIG. 36 is ADI-55743. In one embodiment, the antibody, or antigen-binding fragment thereof, of FIG. 1, FIG. 2 or FIG. 36 is ADI-55744. In one embodiment, the antibody, or antigen-binding fragment thereof, of FIG. 1, FIG. 2 or FIG. 36 is ADI-55745. In one embodiment, the antibody, or antigen-binding fragment thereof, of FIG. 1, FIG. 2 or FIG. 36 is ADI-55746. In one embodiment, the antibody, or antigen-binding fragment thereof, of FIG. 1, FIG. 2 or FIG. 36 is ADI-55747. In one embodiment, the antibody, or antigen-binding fragment thereof, of FIG. 1, FIG. 2 or FIG. 36 is ADI-55748. In one embodiment, the antibody, or antigen-binding fragment thereof, of FIG. 1, FIG. 2 or FIG. 36 is ADI-55749. In one embodiment, the antibody, or antigen-binding fragment thereof, of FIG. 1, FIG. 2 or FIG. 36 is ADI-55750. In one embodiment, the antibody, or antigen-binding fragment thereof, of FIG. 1, FIG. 2 or FIG. 36 is ADI-55751. In one embodiment, the antibody, or antigen-binding fragment thereof, of FIG. 1, FIG. 2 or FIG. 36 is ADI-55752. In one embodiment, the antibody, or antigen-binding fragment thereof, of FIG. 1, FIG. 2 or FIG. 36 is ADI-55753. In one embodiment, the antibody, or antigen-binding fragment thereof, of FIG. 1, FIG. 2 or FIG. 36 is ADI-55754. In one embodiment, the antibody, or antigen-binding fragment thereof, of FIG. 1, FIG. 2 or FIG. 36 is ADI-55755. In one embodiment, the antibody, or antigen-binding fragment thereof, of FIG. 1, FIG. 2 or FIG. 36 is ADI-55756. In one embodiment, the antibody, or antigen-binding fragment thereof, of FIG. 1, FIG. 2 or FIG. 36 is ADI-55757. In one embodiment, the antibody, or antigen-binding fragment thereof, of FIG. 1, FIG. 2 or FIG. 36 is ADI-55758. In one embodiment, the antibody, or antigen-binding fragment thereof, of FIG. 1, FIG. 2 or FIG. 36 is ADI-55720. In one embodiment, the antibody, or antigen-binding fragment thereof, of FIG. 1, FIG. 2 or FIG. 36 is ADI-55760. In one embodiment, the antibody, or antigen-binding fragment thereof, of FIG. 1, FIG. 2 or FIG. 36 is ADI-55761. In one embodiment, the antibody, or antigen-binding fragment thereof, of FIG. 1, FIG. 2 or FIG. 36 is ADI-55762. In one embodiment, the antibody, or antigen-binding fragment thereof, of FIG. 1, FIG. 2 or FIG. 36 is ADI-55763. In one embodiment, the antibody, or antigen-binding fragment thereof, of FIG. 1, FIG. 2 or FIG. 36 is ADI-55765. In one embodiment, the antibody, or antigen-binding fragment thereof, of FIG. 1, FIG. 2 or FIG. 36 is ADI-55766. In one embodiment, the antibody, or antigen-binding fragment thereof, of FIG. 1, FIG. 2 or FIG. 36 is ADI-55767. In one embodiment, the antibody, or antigen-binding fragment thereof, of FIG. 1, FIG. 2 or FIG. 36 is ADI-55769. In one embodiment, the antibody, or antigen-binding fragment thereof, of FIG. 1, FIG. 2 or FIG. 36 is ADI-55770. In one embodiment, the antibody, or antigen-binding fragment thereof, of FIG. 1, FIG. 2 or FIG. 36 is ADI-55771. In one embodiment, the antibody, or antigen-binding fragment thereof, of FIG. 1, FIG. 2 or FIG. 36 is ADI-55775. In one embodiment, the antibody, or antigen-binding fragment thereof, of FIG. 1, FIG. 2 or FIG. 36 is ADI-55776. In one embodiment, the antibody, or antigen-binding fragment thereof, of FIG. 1, FIG. 2 or FIG. 36 is ADI-55777. In one embodiment, the antibody, or antigen-binding fragment thereof, of FIG. 1, FIG. 2 or FIG. 36 is ADI-55950. In one embodiment, the antibody, or antigen-binding fragment thereof, of FIG. 1, FIG. 2 or FIG. 36 is ADI-55951. In one embodiment, the antibody, or antigen-binding fragment thereof, of FIG. 1, FIG. 2 or FIG. 36 is ADI-55952. In one embodiment, the antibody, or antigen-binding fragment thereof, of FIG. 1, FIG. 2 or FIG. 36 is ADI-55953. In one embodiment, the antibody, or antigen-binding fragment thereof, of FIG. 1, FIG. 2 or FIG. 36 is ADI-55954. In one embodiment, the antibody, or antigen-binding fragment thereof, of FIG. 1, FIG. 2 or FIG. 36 is ADI-55955. In one embodiment, the antibody, or antigen-binding fragment thereof, of FIG. 1, FIG. 2 or FIG. 36 is ADI-55956. In one embodiment, the antibody, or antigen-binding fragment thereof, of FIG. 1, FIG. 2 or FIG. 36 is ADI-55957. In one embodiment, the antibody, or antigen-binding fragment thereof, of FIG. 1, FIG. 2 or FIG. 36 is ADI-55958. In one embodiment, the antibody, or antigen-binding fragment thereof, of FIG. 1, FIG. 2 or FIG. 36 is ADI-55959. In one embodiment, the antibody, or antigen-binding fragment thereof, of FIG. 1, FIG. 2 or FIG. 36 is ADI-55960. In one embodiment, the antibody, or antigen-binding fragment thereof, of FIG. 1, FIG. 2 or FIG. 36 is ADI-55961. In one embodiment, the antibody, or antigen-binding fragment thereof, of FIG. 1, FIG. 2 or FIG. 36 is ADI-55962. In one embodiment, the antibody, or antigen-binding fragment thereof, of FIG. 1, FIG. 2 or FIG. 36 is ADI-55963. In one embodiment, the antibody, or antigen-binding fragment thereof, of FIG. 1, FIG. 2 or FIG. 36 is ADI-55964. In one embodiment, the antibody, or antigen-binding fragment thereof, of FIG. 1, FIG. 2 or FIG. 36 is ADI-55965. In one embodiment, the antibody, or antigen-binding fragment thereof, of FIG. 1, FIG. 2 or FIG. 36 is ADI-55966. In one embodiment, the antibody, or antigen-binding fragment thereof, of FIG. 1, FIG. 2 or FIG. 36 is ADI-55967. In one embodiment, the antibody, or antigen-binding fragment thereof, of FIG. 1, FIG. 2 or FIG. 36 is ADI-55968. In one embodiment, the antibody, or antigen-binding fragment thereof, of FIG. 1, FIG. 2 or FIG. 36 is ADI-55969. In one embodiment, the antibody, or antigen-binding fragment thereof, of FIG. 1, FIG. 2 or FIG. 36 is ADI-55970. In one embodiment, the antibody, or antigen-binding fragment thereof, of FIG. 1, FIG. 2 or FIG. 36 is ADI-55972. In one embodiment, the antibody, or antigen-binding fragment thereof, of FIG. 1, FIG. 2 or FIG. 36 is ADI-55973. In one embodiment, the antibody, or antigen-binding fragment thereof, of FIG. 1, FIG. 2 or FIG. 36 is ADI-55974. In one embodiment, the antibody, or antigen-binding fragment thereof, of FIG. 1, FIG. 2 or FIG. 36 is ADI-55975. In one embodiment, the antibody, or antigen-binding fragment thereof, of FIG. 1, FIG. 2 or FIG. 36 is ADI-55976. In one embodiment, the antibody, or antigen-binding fragment thereof, of FIG. 1, FIG. 2 or FIG. 36 is ADI-55977. In one embodiment, the antibody, or antigen-binding fragment thereof, of FIG. 1, FIG. 2 or FIG. 36 is ADI-55978. In one embodiment, the antibody, or antigen-binding fragment thereof, of FIG. 1, FIG. 2 or FIG. 36 is ADI-55979. In one embodiment, the antibody, or antigen-binding fragment thereof, of FIG. 1, FIG. 2 or FIG. 36 is ADI-55980. In one embodiment, the antibody, or antigen-binding fragment thereof, of FIG. 1, FIG. 2 or FIG. 36 is ADI-55981. In one embodiment, the antibody, or antigen-binding fragment thereof, of FIG. 1, FIG. 2 or FIG. 36 is ADI-55982. In one embodiment, the antibody, or antigen-binding fragment thereof, of FIG. 1, FIG. 2 or FIG. 36 is ADI-55984. In one embodiment, the antibody, or antigen-binding fragment thereof, of FIG. 1, FIG. 2 or FIG. 36 is ADI-55986. In one embodiment, the antibody, or antigen-binding fragment thereof, of FIG. 1, FIG. 2 or FIG. 36 is ADI-55988. In one embodiment, the antibody, or antigen-binding fragment thereof, of FIG. 1, FIG. 2 or FIG. 36 is ADI-55989. In one embodiment, the antibody, or antigen-binding fragment thereof, of FIG. 1, FIG. 2 or FIG. 36 is ADI-55990. In one embodiment, the antibody, or antigen-binding fragment thereof, of FIG. 1, FIG. 2 or FIG. 36 is ADI-55992. In one embodiment, the antibody, or antigen-binding fragment thereof, of FIG. 1, FIG. 2 or FIG. 36 is ADI-55993. In one embodiment, the antibody, or antigen-binding fragment thereof, of FIG. 1, FIG. 2 or FIG. 36 is ADI-55994. In one embodiment, the antibody, or antigen-binding fragment thereof, of FIG. 1, FIG. 2 or FIG. 36 is ADI-55995. In one embodiment, the antibody, or antigen-binding fragment thereof, of FIG. 1, FIG. 2 or FIG. 36 is ADI-55996. In one embodiment, the antibody, or antigen-binding fragment thereof, of FIG. 1, FIG. 2 or FIG. 36 is ADI-55997. In one embodiment, the antibody, or antigen-binding fragment thereof, of FIG. 1, FIG. 2 or FIG. 36 is ADI-55998. In one embodiment, the antibody, or antigen-binding fragment thereof, of FIG. 1, FIG. 2 or FIG. 36 is ADI-55999. In one embodiment, the antibody, or antigen-binding fragment thereof, of FIG. 1, FIG. 2 or FIG. 36 is ADI-56000. In one embodiment, the antibody, or antigen-binding fragment thereof, of FIG. 1, FIG. 2 or FIG. 36 is ADI-56001. In one embodiment, the antibody, or antigen-binding fragment thereof, of FIG. 1, FIG. 2 or FIG. 36 is ADI-56002. In one embodiment, the antibody, or antigen-binding fragment thereof, of FIG. 1, FIG. 2 or FIG. 36 is ADI-56003. In one embodiment, the antibody, or antigen-binding fragment thereof, of FIG. 1, FIG. 2 or FIG. 36 is ADI-56004. In one embodiment, the antibody, or antigen-binding fragment thereof, of FIG. 1, FIG. 2 or FIG. 36 is ADI-56005 ADI-56006. In one embodiment, the antibody, or antigen-binding fragment thereof, of FIG. 1, FIG. 2 or FIG. 36 is ADI-56007. In one embodiment, the antibody, or antigen-binding fragment thereof, of FIG. 1, FIG. 2 or FIG. 36 is ADI-56008. In one embodiment, the antibody, or antigen-binding fragment thereof, of FIG. 1, FIG. 2 or FIG. 36 is ADI-56009. In one embodiment, the antibody, or antigen-binding fragment thereof, of FIG. 1, FIG. 2 or FIG. 36 is ADI-56010. In one embodiment, the antibody, or antigen-binding fragment thereof, of FIG. 1, FIG. 2 or FIG. 36 is ADI-56011. In one embodiment, the antibody, or antigen-binding fragment thereof, of FIG. 1, FIG. 2 or FIG. 36 is ADI-56012. In one embodiment, the antibody, or antigen-binding fragment thereof, of FIG. 1, FIG. 2 or FIG. 36 is ADI-56013. In one embodiment, the antibody, or antigen-binding fragment thereof, of FIG. 1, FIG. 2 or FIG. 36 is ADI-56014. In one embodiment, the antibody, or antigen-binding fragment thereof, of FIG. 1, FIG. 2 or FIG. 36 is ADI-56015. In one embodiment, the antibody, or antigen-binding fragment thereof, of FIG. 1, FIG. 2 or FIG. 36 is ADI-56016. In one embodiment, the antibody, or antigen-binding fragment thereof, of FIG. 1, FIG. 2 or FIG. 36 is ADI-56017. In one embodiment, the antibody, or antigen-binding fragment thereof, of FIG. 1, FIG. 2 or FIG. 36 is ADI-56018. In one embodiment, the antibody, or antigen-binding fragment thereof, of FIG. 1, FIG. 2 or FIG. 36 is ADI-56019. In one embodiment, the antibody, or antigen-binding fragment thereof, of FIG. 1, FIG. 2 or FIG. 36 is ADI-56020. In one embodiment, the antibody, or antigen-binding fragment thereof, of FIG. 1, FIG. 2 or FIG. 36 is ADI-56021. In one embodiment, the antibody, or antigen-binding fragment thereof, of FIG. 1, FIG. 2 or FIG. 36 is ADI-56022. In one embodiment, the antibody, or antigen-binding fragment thereof, of FIG. 1, FIG. 2 or FIG. 36 is ADI-56023. In one embodiment, the antibody, or antigen-binding fragment thereof, of FIG. 1, FIG. 2 or FIG. 36 is ADI-56024. In one embodiment, the antibody, or antigen-binding fragment thereof, of FIG. 1, FIG. 2 or FIG. 36 is ADI-56025. In one embodiment, the antibody, or antigen-binding fragment thereof, of FIG. 1, FIG. 2 or FIG. 36 is ADI-56026. In one embodiment, the antibody, or antigen-binding fragment thereof, of FIG. 1, FIG. 2 or FIG. 36 is ADI-56027. In one embodiment, the antibody, or antigen-binding fragment thereof, of FIG. 1, FIG. 2 or FIG. 36 is ADI-56028. In one embodiment, the antibody, or antigen-binding fragment thereof, of FIG. 1, FIG. 2 or FIG. 36 is ADI-56029. In one embodiment, the antibody, or antigen-binding fragment thereof, of FIG. 1, FIG. 2 or FIG. 36 is ADI-56030. In one embodiment, the antibody, or antigen-binding fragment thereof, of FIG. 1, FIG. 2 or FIG. 36 is ADI-56031. In one embodiment, the antibody, or antigen-binding fragment thereof, of FIG. 1, FIG. 2 or FIG. 36 is ADI-56032. In one embodiment, the antibody, or antigen-binding fragment thereof, of FIG. 1, FIG. 2 or FIG. 36 is ADI-56033. In one embodiment, the antibody, or antigen-binding fragment thereof, of FIG. 1, FIG. 2 or FIG. 36 is ADI-56034. In one embodiment, the antibody, or antigen-binding fragment thereof, of FIG. 1, FIG. 2 or FIG. 36 is ADI-56035. In one embodiment, the antibody, or antigen-binding fragment thereof, of FIG. 1, FIG. 2 or FIG. 36 is ADI-56037. In one embodiment, the antibody, or antigen-binding fragment thereof, of FIG. 1, FIG. 2 or FIG. 36 is ADI-56038. In one embodiment, the antibody, or antigen-binding fragment thereof, of FIG. 1, FIG. 2 or FIG. 36 is ADI-56039. In one embodiment, the antibody, or antigen-binding fragment thereof, of FIG. 1, FIG. 2 or FIG. 36 is ADI-56040. In one embodiment, the antibody, or antigen-binding fragment thereof, of FIG. 1, FIG. 2 or FIG. 36 is ADI-56041. In one embodiment, the antibody, or antigen-binding fragment thereof, of FIG. 1, FIG. 2 or FIG. 36 is ADI-56042. In one embodiment, the antibody, or antigen-binding fragment thereof, of FIG. 1, FIG. 2 or FIG. 36 is ADI-56043. In one embodiment, the antibody, or antigen-binding fragment thereof, of FIG. 1, FIG. 2 or FIG. 36 is ADI-56044. In one embodiment, the antibody, or antigen-binding fragment thereof, of FIG. 1, FIG. 2 or FIG. 36 is ADI-56045. In one embodiment, the antibody, or antigen-binding fragment thereof, of FIG. 1, FIG. 2 or FIG. 36 is ADI-56046. In one embodiment, the antibody, or antigen-binding fragment thereof, of FIG. 1, FIG. 2 or FIG. 36 is ADI-56047. In one embodiment, the antibody, or antigen-binding fragment thereof, of FIG. 1, FIG. 2 or FIG. 36 is ADI-56048. In one embodiment, the antibody, or antigen-binding fragment thereof, of FIG. 1, FIG. 2 or FIG. 36 is ADI-56049. In one embodiment, the antibody, or antigen-binding fragment thereof, of FIG. 1, FIG. 2 or FIG. 36 is ADI-56050. In one embodiment, the antibody, or antigen-binding fragment thereof, of FIG. 1, FIG. 2 or FIG. 36 is ADI-56051. In one embodiment, the antibody, or antigen-binding fragment thereof, of FIG. 1, FIG. 2 or FIG. 36 is ADI-56052. In one embodiment, the antibody, or antigen-binding fragment thereof, of FIG. 1, FIG. 2 or FIG. 36 is ADI-56053. In one embodiment, the antibody, or antigen-binding fragment thereof, of FIG. 1, FIG. 2 or FIG. 36 is ADI-56054. In one embodiment, the antibody, or antigen-binding fragment thereof, of FIG. 1, FIG. 2 or FIG. 36 is ADI-56055. In one embodiment, the antibody, or antigen-binding fragment thereof, of FIG. 1, FIG. 2 or FIG. 36 is ADI-56056. In one embodiment, the antibody, or antigen-binding fragment thereof, of FIG. 1, FIG. 2 or FIG. 36 is ADI-56057. In one embodiment, the antibody, or antigen-binding fragment thereof, of FIG. 1, FIG. 2 or FIG. 36 is ADI-56058. In one embodiment, the antibody, or antigen-binding fragment thereof, of FIG. 1, FIG. 2 or FIG. 36 is ADI-56059. In one embodiment, the antibody, or antigen-binding fragment thereof, of FIG. 1, FIG. 2 or FIG. 36 is ADI-56061. In one embodiment, the antibody, or antigen-binding fragment thereof, of FIG. 1, FIG. 2 or FIG. 36 is ADI-56062. In one embodiment, the antibody, or antigen-binding fragment thereof, of FIG. 1, FIG. 2 or FIG. 36 is ADI-56063. In one embodiment, the antibody, or antigen-binding fragment thereof, of FIG. 1, FIG. 2 or FIG. 36 is ADI-56064. In one embodiment, the antibody, or antigen-binding fragment thereof, of FIG. 1, FIG. 2 or FIG. 36 is ADI-56065. In one embodiment, the antibody, or antigen-binding fragment thereof, of FIG. 1, FIG. 2 or FIG. 36 is ADI-56066. In one embodiment, the antibody, or antigen-binding fragment thereof, of FIG. 1, FIG. 2 or FIG. 36 is ADI-56067. In one embodiment, the antibody, or antigen-binding fragment thereof, of FIG. 1, FIG. 2 or FIG. 36 is ADI-56068. In one embodiment, the antibody, or antigen-binding fragment thereof, of FIG. 1, FIG. 2 or FIG. 36 is ADI-56069. In one embodiment, the antibody, or antigen-binding fragment thereof, of FIG. 1, FIG. 2 or FIG. 36 is ADI-56070. In one embodiment, the antibody, or antigen-binding fragment thereof, of FIG. 1, FIG. 2 or FIG. 36 is ADI-56071. In one embodiment, the antibody, or antigen-binding fragment thereof, of FIG. 1, FIG. 2 or FIG. 36 is ADI-56072. In one embodiment, the antibody, or antigen-binding fragment thereof, of FIG. 1, FIG. 2 or FIG. 36 is ADI-56073. In one embodiment, the antibody, or antigen-binding fragment thereof, of FIG. 1, FIG. 2 or FIG. 36 is ADI-56074. In one embodiment, the antibody, or antigen-binding fragment thereof, of FIG. 1, FIG. 2 or FIG. 36 is ADI-56075 ADI-56076. In one embodiment, the antibody, or antigen-binding fragment thereof, of FIG. 1, FIG. 2 or FIG. 36 is ADI-56078. In one embodiment, the antibody, or antigen-binding fragment thereof, of FIG. 1, FIG. 2 or FIG. 36 is ADI-56079. In one embodiment, the antibody, or antigen-binding fragment thereof, of FIG. 1, FIG. 2 or FIG. 36 is ADI-56080. In one embodiment, the antibody, or antigen-binding fragment thereof, of FIG. 1, FIG. 2 or FIG. 36 is ADI-56081. In one embodiment, the antibody, or antigen-binding fragment thereof, of FIG. 1, FIG. 2 or FIG. 36 is ADI-56082. In one embodiment, the antibody, or antigen-binding fragment thereof, of FIG. 1, FIG. 2 or FIG. 36 is ADI-56083. In one embodiment, the antibody, or antigen-binding fragment thereof, of FIG. 1, FIG. 2 or FIG. 36 is ADI-56084. In one embodiment, the antibody, or antigen-binding fragment thereof, of FIG. 1, FIG. 2 or FIG. 36 is ADI-56443. In one embodiment, the antibody, or antigen-binding fragment thereof, of FIG. 1, FIG. 2 or FIG. 36 is ADI-56479. In one embodiment, the antibody, or antigen-binding fragment thereof, of FIG. 1, FIG. 2 or FIG. 36 is ADI-58120. In one embodiment, the antibody, or antigen-binding fragment thereof, of FIG. 1, FIG. 2 or FIG. 36 is ADI-58121. In one embodiment, the antibody, or antigen-binding fragment thereof, of FIG. 1, FIG. 2 or FIG. 36 is ADI-58122. In one embodiment, the antibody, or antigen-binding fragment thereof, of FIG. 1, FIG. 2 or FIG. 36 is ADI-58123. In one embodiment, the antibody, or antigen-binding fragment thereof, of FIG. 1, FIG. 2 or FIG. 36 is ADI-58124. In one embodiment, the antibody, or antigen-binding fragment thereof, of FIG. 1, FIG. 2 or FIG. 36 is ADI-58125. In one embodiment, the antibody, or antigen-binding fragment thereof, of FIG. 1, FIG. 2 or FIG. 36 is ADI-58126. In one embodiment, the antibody, or antigen-binding fragment thereof, of FIG. 1, FIG. 2 or FIG. 36 is ADI-58127. In one embodiment, the antibody, or antigen-binding fragment thereof, of FIG. 1, FIG. 2 or FIG. 36 is ADI-58128. In one embodiment, the antibody, or antigen-binding fragment thereof, of FIG. 1, FIG. 2 or FIG. 36 is ADI-58129. In one embodiment, the antibody, or antigen-binding fragment thereof, of FIG. 1, FIG. 2 or FIG. 36 is ADI-58130. In one embodiment, the antibody, or antigen-binding fragment thereof, of FIG. 1, FIG. 2 or FIG. 36 is ADI-58131. In one embodiment, the antibody, or antigen-binding fragment thereof, of FIG. 1, FIG. 2 or FIG. 36 is ADI-58130_LCN30cQ. In one embodiment, the antibody, or antigen-binding fragment thereof, of FIG. 1, FIG. 2 or FIG. 36 is ADI-59988.

BRIEF DESCRIPTION OF THE DRAWINGS

FIGS. 1A-1I provide the SEQ ID NOs assigned to the respective VH FR1, VH CDR1, VH FR2, VH CDR2, VH FR3, VH CDR3, and VH FR4 amino acid sequences, the respective VH amino acid sequences, and the respective VH-encoding nucleic acid sequences for 211 antibodies as indicated.

FIGS. 2A-2I provide the SEQ ID NOs assigned to the respective VL FR1, VL CDR1, VL FR2, VL CDR2, VL FR3, VL CDR3, and VL FR4 amino acid sequences, the respective VL amino acid sequences, and the respective VH-encoding nucleic acid sequences for 211 antibodies as indicated.

FIGS. 3A-3E provide the germline origin of the VH and VL of each of the 211 antibodies.

FIGS. 4A-4I provide the number of nucleotide substitutions in the VH-encoding and VL-encoding sequences as compared to the germline sequences and the number of amino acid alterations in the VH and VL polypeptide sequences as compared to the germline-encoded VH and VL sequences, for each of the antibodies. Eight antibodies were not analyzed (in this and some of other studies) due to the high sequence similarity to another antibody within the 211 antibodies, and were shown as blank.

FIGS. 5A-5C provide the B cell isotype of the 211 antibodies.

FIGS. 6A-6E provide the summary of SARS-CoV-2-S-binding B cell isolation and determination of the germline origin and isotype of each of the isolated antibodies. FIG. 6A shows the frequency of SARS-CoV-2 S-reactive B cells in VRC #202367 (a convalescent SARS-CoV donor) and a negative control SARS-CoV naive donor. Fluorescence activated cell sorting (FACS) plots shown are gated on $CD19^+$ $CD20^+IgD^-IgM^-$ B cells. SARS-CoV-2 S was labeled with two different colors to reduce background binding. FIG. 6B shows binding of 315 isolated antibodies to SARS-CoV-2 S, as determined by BLI. The solid line indicates the threshold used for designating binders (0.1 RUs). FIG. 6C shows clonal lineage analysis. Each lineage is represented as a segment proportional to the lineage size. Antibodies that utilize VH1-69/VK2-30 germline gene pairing are shown in blue. Other germlines are shown in dark gray. The total number of isolated antibodies is shown in the center of the pie. Clonal lineages were defined based on the following criteria: identical VH and VL germline gene, identical VH CDR3 length, and VH CDR3 amino acid identity ≥80%. FIG. 6D shows the load of somatic mutations, expressed as number of nucleotide substitutions in VH, in unique antibodies and members of expanded clonal lineages. FIG. 6E shows the percentage of antibodies having the IgA+ isotype and antibodies having the IgG+ isotype. Proportion of SARS-CoV-2-S-binding antibodies derived from $IgG^+$ and $IgA^+$ B cells, as determined by index sorting. Statistical comparisons were made using the Mann-Whitney test (****$P<0.0001$). Red bars indicate medians. RU, response unit; VH, variable region of the heavy chain.

FIGS. 7A-7I show part of the results from the binding assays in Example 2. The KD [M], $k_{on}$ [M$^{-1}$ s$^{-1}$], $k_{off}$ [s$^{-1}$], and Binding Response (nm) for the S protein of SARS-CoV and SARS-CoV-2, for the 211 antibodies, are provided.

FIGS. 8A-8E show part of the results from the binding assays in Example 3. The KD [M], $k_{on}$ [M$^{-1}$ s$^{-1}$], $k_{off}$ [s$^{-1}$], and Binding Response (n) for the S protein of HCoV-229E (an endemic/seasonal/circulating species), for the 211 antibodies, are provided.

FIGS. 9A-9E show part of the results from the binding assays in Example 3. The KD [M], $k_{on}$ [M$^{-1}$ s$^{-1}$], $k_{off}$ [s$^{-1}$], and Binding Response (nm) for the S protein of HCoV-HKU1 (an endemic/seasonal/circulating species), for the 211 antibodies, are provided.

FIGS. 10A-10E show part of the results from the binding assays in Example 3. The KD [M], $k_{on}$ [M$^{-1}$ s$^{-1}$], $k_{off}$ [s$^{-1}$], and Binding Response (nm) for the S protein of HCoV-NL63 (an endemic/seasonal/circulating species), for the 211 antibodies, are provided.

FIGS. 11A-11E show part of the results from the binding assays in Example 3. The KD [M], $k_{on}$ [M$^{-1}$ s$^{-1}$], $k_{off}$ [s$^{-1}$], and Binding Response (nm) for the S protein of HCoV-OC43 (an endemic/seasonal/circulating species), for the 211 antibodies, are provided.

FIGS. 12A-12I provide a summary of the binding affinity results from FIGS. 7-11. When an antibody showed a binding response (nm) value of 0.1 or higher for a target, the antibody was considered as a binder (shown as "Yes") to that target. Note that antibodies with a binding response value such as 0.099 or 0.098 that can be round to 0.1 were also considered as binders and shown as "Yes". When an antibody showed a binding response (nm) value of <0.1 for a target in FIGS. 7-11, the antibody was considered as a non-binder (shown as "No") for that target. When an antibody was "Yes" for SARS-CoV-S and/or SARS-CoV-2-S but "No" for all of S protein of the circulating CoV species (HCoV-229E, HCoV-HKU, HCoV-NL63, and HCoV-0K43), the antibody is classified as "SARS1-2 specific". When an antibody was "Yes" for SARS-CoV-S and/or SARS-CoV-2-S and also "Yes" for the S protein of one or more the circulating CoV species (HCoV-229E, HCoV-HKU, HCoV-NL63, and HCoV-0K43), the antibody is classified as "Broad".

FIGS. 13A-13C provide the polyspecificity score and polyspecificity category for each antibody.

FIG. 14A shows apparent binding affinities of SARS-CoV-2 S-specific IgGs to recombinant prefusion-stabilized SARS-CoV-S and SARS-CoV-2-S proteins, as determined by BLI measurements. Antibodies for which binding curves could not be fit are designated as "p.f." (meaning "poor fit") on the plot. The majority of tested mAbs (153 out of 202) binds to both SARS-CoV-S and SARS-CoV-S, while a subset of mAbs are SARS-CoV-2 S-specific and that over half of the cross-reactive antibodies (89/153) bound with KDApp>10 nM to both SARS-CoV and SARS-CoV-2 S. FIG. 14B provides a heat map showing $K_D^{APPs}$ of the isolated antibodies for SARS-CoV, SARS-CoV-2, 229E, HKU1, NL63, and OC43 S proteins. Germline gene usage, clonal expansion, and SHM are indicated in the three leftmost panels. N.B., non-binder. FIG. 14C provides the load of somatic mutations in broadly cross-reactive ("Broad") and SARS-CoV/SARS-CoV-2-specific ("SARS1/2 only") antibodies. Black bars indicate medians. FIG. 14D provides the degree of clonal expansion in broadly cross-reactive ("Broad") and SARS-CoV/SARS-CoV-2-specific ("SARS1/2 only") antibodies. Each lineage is represented as a segment proportional to the lineage size. The total number of antibodies is shown in the center of the pie. FIG. 14E shows the proportion of broadly cross-reactive ("Broad") and SARS-CoV/SARS-CoV-2-specific ("SARS1/2 only") antibodies derived from IgG$^+$ and IgA$^+$ B cells, as determined by index sorting. FIG. 14F shows the load of somatic mutations in SARS-CoV-2 S-reactive antibodies isolated from three naive donors and VRC #202367. Antibodies from naïve donors are pooled for this analysis. FIG. 14G compares the binding activity of SARS-CoV-2 S-reactive antibodies isolated from three naïve donors and VRC #202367, as determined by BLI. The statistical significance (**) is between the data from VRC #202367 and pooled data from three naïve donors FIG. 14H shows VH/VL germline gene usage of SARS-CoV-2 S-specific antibodies that display cross-reactivity with circulating HCoV S proteins. FIGS. 14I and 14J show ELISA binding reactivity of healthy donor sera to SARS-CoV-2, SARS-CoV, and circulating HCoV S proteins. CR3022 is included as a positive control. FIG. 14K shows the percentage of SARS-CoV-2 S-specific B cells observed in each naïve donor, as determined by flow cytometry. FIG. 14L shows the clonal lineage analysis. Each lineage is represented as a segment proportional to the lineage size. The total number of isolated antibodies is shown in the center of each pie. Clonal lineages were defined based on the following criteria: identical VH and VL germline gene, identical CDR H3 length, and CDR H3 amino acid identity ≥80%. Clonal lineages are not shown for Donor 1 because only three SARS-CoV-2 S-specific antibodies were isolated from this donor.

FIGS. 15A-15I show part of the results from the epitope mapping assays in Example 4. The $K_D$ [M], $k_{on}$ [M$^{-1}$ s$^{-1}$], $k_{off}$ [s$^{-1}$], and Binding Response (nm) data for the S1 subunit (monovalent or bivalent ("AVID")) of the S protein of SARS-CoV-2, for each antibody are provided.

FIGS. 16A-16E show part of the results from the epitope mapping assays in Example 4. The $K_D$ [M], $k_{on}$ [M$^{-1}$ s$^{-1}$], $k_{off}$ [s$^{-1}$], and Binding Response (nm) data for the S2 subunit of the S protein of SARS-CoV-2, for each antibody are provided.

FIGS. 17A-17I show part of the results from the epitope mapping assays in Example 4. The $K_D$ [M], $k_{on}$ [M$^{-1}$ s$^{-1}$], $k_{off}$ [s$^-$], and Binding Response (nm) data for the RBD domain (monovalent or bivalent ("AVID") of the S protein of SARS-CoV-2, for each antibody are provided.

FIGS. 18A-18E show some of the results from the epitope mapping assays in Example 4. The $K_D$ [M], $k_{on}$ [M$^{-1}$ s$^{-1}$], $k_{off}$ [s$^{-1}$], and Binding Response (nm) data for the N-terminal domain (NTD) of the S protein of SARS-CoV-2, for each antibody are provided.

FIGS. 19A-19I provide a summary of the binding affinity results from FIGS. 15-18. In these figures, when an antibody showed a binding response (nm) value of 0.1 or higher for a target, the antibody was considered as a binder (shown as "Yes") to that target. Note that for antibodies with a binding response value such as 0.099 or 0.098 that can be round up to 0.1; these antibodies were also identified as binders and shown as "Yes". By contrast, when an antibody showed a binding response (nm) value of <0.1 for a target in FIGS. 15-18, the antibody was considered as a non-binder (shown as "No") for that target.

FIGS. 20A-20F provide the results from the cell binding assays in Example 5. FIGS. 20A-20E show binding of each antibody to cells engineered to express the S protein of SARS-CoV-2 on the surface is shown in fold binding over background and in EC50 [nM]. FIG. 20F shows binding of SARS-CoV-2 S-specific antibodies to SARS-CoV S expressed on the surface of cells. As shown therein none of the antibodies tested showed significant binding to recombinant prefusion-stabilized SARS-CoV S, as determined by BLI. In these binding assays antibodies were tested at a 100 nM concentration.

FIGS. 21A-21E show the results from the binding competition assays in Example 4. The figures show whether the binding of each tested antibody competed with ACE2 or a commercially available antibody, CR3022.

FIG. 21F is a summary of results shown in FIGS. 15-18 and 21. The chart provides the proportion of different antigenic sites within SARS-CoV-2-S of the 65 tested antibodies that bind to SARS-CoV-2-S with $K_D^{APPs}$<10 nM. The different antigenic sites are the S2 subunit, the NTD within the S1 subunit, and the RBD within the S1 subunit. As shown therein of the antibodies that bound to the RBD, only some competed with hACE2. Those which did not compete with hACE2 are also shown.

FIGS. 22A-22I show the results from the neutralization assays in Example 6.

FIG. 23A provides a graph showing percent authentic SARS-CoV-2 infection observed in the presence of each antibody identified by "Antibody index" (x axis) at a concentration of 100 nM. The corresponding antibody names are shown in Table 5 below. Bars are colored by targeted antigenic site. FIG. 23B provides a graph showing the % neutralization of authentic SARS-CoV-2 virus of each antibody (y axis) by the epitope/antigenic site within SARS-CoV-2-S(x axis). For RBD-binding antibodies, the target is further specified by whether the antibody competes with hACE2. FIG. 23C provides a heat map showing the neutralizing activities and competitive binding profiles of the RBD-directed antibodies. FIG. 23D provides neutralization of authentic SARS-CoV-2 (strain n-CoV/USA_WA1/2020) by antibodies as measured by a micro-neutralization assay on Vero E6 cells. The negative control antibody, ADI-26140, is specific for chicken egg lysozyme. CR3022 is included for comparison. FIG. 23E provides a dot plot showing binding to cell-surface SARS-CoV-2 S (shown in FOB on y axis) versus SARS-CoV-2 neutralization at a 100 nM concentration (shown in % on x axis). Each point represents a single antibody and data points are colored by the antigenic site. In the figure "FOB" refers to fold over background.

FIG. 23F provides neutralization of SARS-CoV and SARS-CoV-2 MLV pseudovirus (strain n-COV/USA_WA1/2020) by eight antibodies using HeLa-ACE2 target cells. FIG. 23G provides neutralization of authentic SARS-CoV and SARS-CoV-2 using Vero E6 target cells. Data represents two technical replicates. Antibodies with black arrow were selected for affinity maturation in Example 12.

FIG. 25 provides a summary of neutralization IC50 [ug/mL] values for neutralization assays using nine selected antibodies and different viruses as shown therein.

FIGS. 27A-27C provide clusters based on the VH CDR3 sequences among selected antibodies, as tested in Example 7.

FIGS. 28A-28B provide sample plots for the clusters containing more than 2 antibodies, i.e., Clusters 1 through 5.

FIG. 31A provides summary information regarding the origin (donor, B cell phenotype, and, if applicable, lineage (i.e., the antibody before affinity maturation induced in Example 12)). epitope within the S protein of SARS-CoV-2, and neutralization IC50 values for five selected antibodies.

FIG. 31B provides a summary of antibody developability parameters measured in Example 18 for five selected antibodies. "pI", isoelectric point; "PSR", interaction with polyspecificity reagent; "HIC", Hydrophobic interaction chromatography; "Tm", melting temperature.

FIGS. 32A-32H provide the results from Examples 16 and 19, the binding kinetics of two antibodies isolated from convalescent COVID-19 patients in Example 15. The binding specificity summary (FIG. 32A) and individual binding parameters for SARS-CoV-2-S (FIG. 32B), for the RBD of SARS-CoV-2-S (FIG. 32C), for the NTD of SARS-CoV-2-S (FIG. 32D), for 51 subunit of SARS-CoV-2-S (FIG. 32E), for S2 subunit of SARS-CoV-2-S (FIG. 32F), and for the seasonal CoV HKU1 S protein (FIG. 32G), and competition assay results (FIG. 32H) are provided.

FIG. 33 provide the results from neutralization assays in Example 17 on two antibodies isolated from convalescent COVID-19 patients.

FIG. 34 provides the amino acid changes made in the five antibodies (ADI-58120, ADI-58124, ADI-58126, ADI-58128, and ADI-58130) to fix the mutation(s) away from the germline-encoded sequence caused by the degenerate primers to match the germline-encoded sequence.

FIG. 35 provides the germline origin of the VH and VL and the number of amino acid or nucleotide substitutions relative to the germline-encoded or greyline sequence, respectively, in the VH and VL of ADI-58120, ADI-58124, ADI-58126, ADI-58128, and ADI-58130 (antibodies after the fixation of "primer mutation" back to the germline sequence as described in FIG. 34).

FIG. 36A provides the SEQ ID NOs assigned to the respective VH FR1, VH CDR1, VH FR2, VH CDR2, VH FR3, VH CDR3, and VH FR4 amino acid sequences, the respective VH amino acid sequences, the respective heavy chain amino acid sequences, and the respective VH-endcoding DNA sequences for different antibodies.

FIG. 36B provides the SEQ ID NOs assigned to the respective VL FR1, VL CDR1, VL FR2, VL CDR2, VL FR3, VL CDR3, and VL FR4 amino acid sequences, the respective VL amino acid sequences, the respective light chain amino acid sequences, and the respective VL-endcoding DNA sequences for different antibodies.

FIG. 37B provides a comparison of the affinity to SARS-CoV-2 S protein of ADI-58124 and its parental antibodies, which are antibodies used to obtain ADI-58124 by affinity maturation (i.e., ADI-55688) and cycle 1 and cycle 2 affinity maturation progenies.

FIG. 37C provides a table summarizing binding kinetics of ADI-58125 as a full IgG or a Fab to SARS-CoV-2 S protein, SARS-CoV-2 RBD, SARS-CoV S protein, SARS-CoV RBD, or WIV-1 RBD.

FIG. 38A compares polyreactivity scores, as determined as described previously (L. Shehata et al., Cell Reports 28, 3300-3308 e3304 (2019)). The thresholds for high, low, and clean polyreactivity were defined based on a previously reported correlation between polyreactivity score and serum half-life in humans (L. Shehata et al., Cell Reports 28, 3300-3308 e3304 (2019)). FIG. 38B compares hydrophobicity, as determined by hydrophobic interaction chromatography. FIG. 38C compares self-interaction propensity (left), as determined by affinity-capture self-interaction nanoparticle spectroscopy (Liu Y. et al., MAbs. March-April 2014; 6(2):483-92). FIG. 38D compares thermal stability (right) defined by Fab melting temperatures, as determined by differential scanning fluorimetry (DSF).

FIG. 39A provides a dot plot showing MLV-SARS-CoV-2 pseudovirus neutralization IC50s of parental antibodies and affinity matured progenies. FIG. 39B provides a heat map (top) and a graph (bottom) showing the neutralization IC50s of the indicated antibodies against authentic SARS-CoV, WIV-1-nluc, SHC014-nluc, SARS-CoV-2-nluc, and SARS-CoV-2 using either HeLa-ACE2 or Vero target cells. SARS-CoV, WIV-1-nluc, SHC014-nluc, and SARS-CoV-2 nluc assays were run using Vero target cells. WIV-1-nluc, SHC014-nluc, and SARS-CoV-2-nluc are recombinant, reverse-genetics-derived viruses encoding a nano-luciferase reporter gene. FIGS. 39C and 39D provide individual neutralization curves of pre- and post-affinity maturation antibodies and clinical antibodies against authentic SARS-CoV, WIV1-nLuc, SHC014-nLuc, and mouse adapted SARS-CoV-2-MA2-nLuc ("SARS2-nLuc") viruses on Vero E6 cells. FIG. 39E provides authentic SARS-CoV-2 neutralization titrations with ADI-58124, performed using either HeLa-ACE2 (left) or Vero (right) target cells. The curves were fitted by nonlinear regression (log[inhibitor] vs. normalized response, variable slope). IC50 values for ADI-58125 and ADI-58129, along with clinical antibodies are also provided. FIG. 39F shows exemplary neutralizing activity by ADI-58124 against WA1 strain of SARS-CoV-2, WT or D614G, measured using an MLV-based pseudovirus assay in HeLa-ACE2 target cells.

FIGS. 39G-39M provide exemplary neutralization data obtained with antibodies according to the present disclosure having a wild-type or non-wild type Fc and with anti-SARS CoV-2 antibodies under clinical trials. FIG. 39G shows neutralization of authentic SARS-CoV-2 by ADI-58125 assayed using ELISA in HeLa-ACE2 cells (top) and VeroE6 cells (bottom). FIG. 39H shows neutralization of SHC014 (top left) and WIV1 (top right) SARS-like coronaviruses from bats (both encoding luciferase reporter) by ADI-58125 assayed using the luciferase assay system in VeroE6 cells. IC50 and IC90 values for ADI-58125 and IC50 values for other antibodies are also provided. FIG. 39I shows neutralization of SARS-CoV pseudotype MLV virus (left), SARS-CoV-2 pseudotype MLV virus (center), or SARS-CoV-2 D614G pseudotype MLV virus (right) (all encoding luciferase reporter) by ADI-58125 assayed using the luciferase assay system in HeLa-ACE2 cells. IC50 and IC90 values for ADI-58125 and IC50 values for ADI-58129 and clinical antibodies are also provided. FIG. 39J shows exemplary inhibition of authentic SARS-CoV infection by indicated antibodies assayed using the method described herein in Vero E6 cells. IC50 values are also provided. FIGS. 39K-39M provide exemplary neutralizing activity by indicated antibodies against SARS-CoV pseudotype MLV virus (top left), SARS-CoV-2 pseudotype MLV virus (top right), and SARS CoV-2 D614G mutant pseudotype MLV virus (bottom), respectively, assayed using the luciferase assay system in HeLa-ACE2 cells.

FIGS. 40A-40J compares the breadth of binding to diverse sarbecoviruses and circulating SARS-CoV-2 variants by ADI-58120, ADI-58124, ADI-58125, and ADI-58126, and anti-SARS-CoV-2 antibodies in clinical trials. ADI-58125 and ADI-58124 share the same CDR sequences and only differ in the Fc region which has been engineered for half-life extension purpose. FIG. 40A provides a phylogenetic tree of 57 sarbecoviruses constructed from mafft and maximum likelihood analysis of RBD-SD1 amino acid sequences extracted from the European Nucleotide Archive and GISAID database. Representative sarbecovirus RBDs included for further study are in bold text and colored according to their canonical phylogenetic lineages. FIG. 40B provides a heat map of apparent equilibrium dissociation constants ($K_D^{APP}$) against 17 representative yeast-displayed RBDs, determined by normalized nonlinear regression fitting. FIG. 40C provides binding to yeast-displayed RBD of naturally-occurring SARS-CoV-2 variants. Briefly, SARS-CoV-2 sequences were retrieved from the GISAID database on Jul. 14, 2020 (n=63551). Mutants observed more than 6 times and published antibody escape mutants also observed in the database were chosen for analysis. Binding signal was normalized to RBD expression and calculated as percent antibody binding to the variant SARS-CoV-2 RBD relative to the WT SARS-CoV-2 RBD, assessed at their respective $K_D^{APP}$ concentrations for the WT RBD construct. The prevalence of each variant, calculated from deposited sequences on Oct. 19, 2020 (n=148115), is shown as a percentage of the total number of sequences analyzed. FIG. 40D provides a graph showing association between the number of natural SARS-CoV-2 variants with observed loss of binding, defined as less than 25% of WT SARS-CoV-2 binding, and percentage of Clade I sarbecovirus RBDs recognized by individual antibodies. FIG. 40E provides a heat map of apparent equilibrium dissociation constants ($K_D^{APP}$) against 17 representative yeast-displayed RBDs, determined by normalized nonlinear regression fitting. KD (nM) values for ADI-58120, ADI-58125, ADI-58126, and clinical antibodies are also provided. FIG. 40F provides binding of ADI-58124 to yeast-displayed RBD of naturally occurring SARS-CoV-2 variants. FIG. 40G provides a comparison between binding of ADI-58125 to yeast-displayed RBD of naturally occurring SARS-CoV-2 variants with other clinical antibodies. FIG. 40H depicts that ADI-58125 binds with comparable affinity to all common circulating SARS-CoV-2 variants and emerging lineages B.1.1.7/501Y.V1 (UK), B.1.351/501Y.V2 (South African) and P.1/501Y.V3 (Brazilian). FIG. 40I depicts that neutralization of P.1., Vctoria, B.1.17 and B.1351 strains by a panel of human monoclonal antibodies. ADI-58122, ADI-58125 and ADI-58127 retained high affinity binding to P.1 variant with all reaching a plateau at 100% neutralization.

FIG. 40J depicts antibody mediated inhibition of SARS-CoV-2 spike (S) protein binding to human ACE2. S binding to ACE2-coated plates was assessed in the presence of varying concentration of selected antibodies in an ELISA assay.

FIGS. 41A-41G demonstrate that ADI-58120, ADI-58124, ADI-58126, and ADI-58128 respectively bind to a conserved epitope on the SARS-CoV-2 RBD overlapping with the hACE2 binding site. FIG. 41A provides a schematic showing the generation and selection of a mutagenized, yeast surface-displayed SARS-CoV-2 RBD library to identify mutations that prevent ADI-58124 binding. FIG. 41B provides exemplary titration curves of indicated antibodies and hACE2 for binding to yeast surface displayed WT SARS-CoV-2 RBD. FIG. 41C provides exemplary flow cytometric selections of clones from mutagenized SARS-CoV-2 RBD library with diminished ADI-58124 binding relative to WT SARS-CoV-2 RBD. FIG. 41D provides a graph showing binding to RBD clones with single amino acid substitutions by indicated antibodies and hACE2 relative to WT RBD. FIG. 41E provides a heat map showing all of the RBD mutations identified from yeast surface display selections that specifically abrogate binding of ADI-58120, ADI-58124, ADI-58125, ADI-58126, ADI-58128, CR3022, REGN10933, REGN10987, JS016, 5309, and/or hACE2. Values indicate percent antibody or hACE2 binding to the mutant SARS-CoV-2 RBD relative to the WT SARS-CoV-2 RBD, assessed at their respective $EC_{80}$ concentrations for the WT RBD construct. FIG. 41F provides a heat map essentially same as the heat map in FIG. 41I1 but only showing RBD mutations that specifically abrogate binding of ADI-58120, ADI-58124, ADI-58125, ADI-58126, and/or ADI-58128 (top) or of ADI-58124 (bottom). FIG. 41G provides a protein sequence alignment of representative sarbecovirus RBDs with sequences colored by percentage sequence identity and conservation shown as a bar plot. Positions delineating the receptor binding motif are based on the SARS-CoV-2 RBD and residues determined to be important for ADI-58124 binding based on fine epitope mapping data shown in FIG. 41D are denoted by star.

FIGS. 42A-42H provide results from the competitive binding analyses in Example 28. FIGS. 42A-42B provide exemplary bio-layer interferometry (BLI) sensograms showing competition between respective antibodies with ACE2 in binding to SARS-CoV-2 S protein. ADI-26140 was used as a negative control. A rise in amplitude in the second step (to the right of the vertical line in the sensorgram) indicates an available binding site for ACE2 binding. FIGS. 42C-42G provide BLI graphs of SARS-CoV-2 S trimer in solution loading onto an anti-heavy chain probe preloaded with respective $1^{st}$ antibodies, followed by loading with respective second antibodies in solution, demonstrating competitive or non-competitive binding between the $1^{st}$ and $2^{nd}$ antibodies. A rise in amplitude in the second step indicates no competition between the $1^{st}$ and $2^{nd}$ antibodies, and no rise in amplitude in the second step indicates competition between the $1^{st}$ and $2^{nd}$ antibodies. FIG. 42H provides a summary of competition between indicated antibodies, or between an indicated antibody and hACE2, based on the competitive binding analyses in Example 28.

FIGS. 43A-43C provide binding of ADI-58124 and ADI-58125 to different Fc gamma receptors (FIG. 43A), human or cynomolgus FcRn (FIG. 43B), and human C1q (FIG. 43C). FIG. 43C depicts that Fc engineering of ADI-58124 resulted in ADI-58125 with improved binding to human and cynomolgus FcRn at low pH. In particular, the expected half-life in humans for ADI-58124 was about 20-25 days, while the expected half-life for ADI-58125 in humans is about 70-115 days.

In FIG. 43E, primary human NK cells were analyzed for surface expression of CD107a, indicating degranulation (top left), and the production of IFNγ (top center) or TNFα (top right) following incubation with antibody-RBD immune complexes for 5 hours. Antibody-mediated phagocytosis of RBD-coated fluorescent beads by differentiated HL-60 neutrophils (bottom left) or THP-1 monocytes (bottom center) was measured following incubation with immune complexes for 18 hours. Antibody-mediated complement deposition was measured by detection of complement component C3 onto RBD-coated fluorescent beads following incubation of guinea pig complement with immune complexes for 20 minutes (bottom right). In FIG. 43E, the area under the curve (AUC) in the three graphs (ADCD, ADCP, and ADNKA CD107a) shown in FIG. 43D was calculated as the sum of the products of response x concentration using GraphPad Prism.

FIG. 44A and FIG. 44B show efficacy of prophylactic treatment with ADI-58125 in SARS-CoV-MA15 and SARS-CoV-2-MA10 challenge models, respectively. A single dose of ADI-58125 or sham treatment were delivered intraperitoneally 12 hours prior to infection. Mouse body weight and respiratory function were monitored for 4 days. Gross lung hemorrhage scores were determined on day 2 (MA15) or day 4 (MA10) post-infection and lung viral titers were measured on day 2 and day 4 post-infection. FIG. 44C provides effects by therapeutic treatment with ADI-58125 or sham treatment at 12 hours post-SARS-CoV-2-MA15-infection. Mouse body weight, respiratory function, gross hemorrhage scores (day 2), and lung viral titers (days 2 and 4) were assessed as described above. Statistical comparisons were made using Mann-Whitney U tests or two-sided t-tests with Holm-Sidak corrections for multiple comparisons (*$P<0.05$, $P<0.01$; *$P<0.001$). Dotted lines indicate the limit of detection. FIG. 44D shows exemplary neutralizing activity by ADI-58124 against SARS-CoV-MA ("SARS1MA")-nLuc or WT or mouse adapted SARS-CoV-2 ("SARS2"), the virus used in the in vivo study. In the top panel, mean and SEM of the luciferase signal are expressed as percentage inhibition or neutralization for ADI-58125 and SARS-CoV MA-nLuc. In the bottom panel, mean and SEM of the luciferase signal are expressed as percentage inhibition or neutralization for ADI-58125 and SARS-CoV-2 MA-nLuc. A table showing IC50s for ADI-58125 in the neutralization curves for SARS1-MA-nLuc and SARS2-MA2-nLuc is also provided.

FIGS. 45A-45B provide results from the studies on potential antibody-dependent enhancement (ADE) in Example 31. Luciferase-labeled reporter viral particles were culture with phagocytes, THP-1 cells (FIG. 45A) or Raji cells (FIG. 45B), in the presence of varied concentrations of respective test antibodies. Increase in the luciferase signal indicates uptake of viral particles by phagocytes.

FIG. 45C provide results from the studies on potential antibody-dependent enhancement (ADE) for ADI-58124 and ADI-58125.

FIG. 49A depicts the mean serum concentration of ADI-58125 after IV fusion and IM administration to male and female cynomolgus monkeys. FIG. 49B depicts the pharmacokinetic parameters of ADI-58125 in male and female Cynomolgus monkeys.

FIGS. 50A-50C depict that ADI-58122 and ADI-58125 potently neutralize UK (B.1.1.7), South African (B.1.351) and/or Brazilian (P.1) SARS-CoV-2 variants. FIG. 50A shows the IC50 values for selected antibodies against the indicated SARS-CoV-2 variants. FIG. 50B depicts the maximal neutralization level for ADI-58122, ADI-58125, REGN10987 and 5309 against the indicated SARS-CoV-2 variants. FIG. 50C depicts the maximal neutralization level for selected antibodies against the indicated SARS-CoV-2 variants.

FIG. 53B depicts the SARS-CoV-2 lung viral loads on Days 3 and 6 (by plaque assay), and FIG. 53C depicts the changes from baseline in weight on Day 6.

DETAILED DESCRIPTION

A. Definitions

Figure 6E:
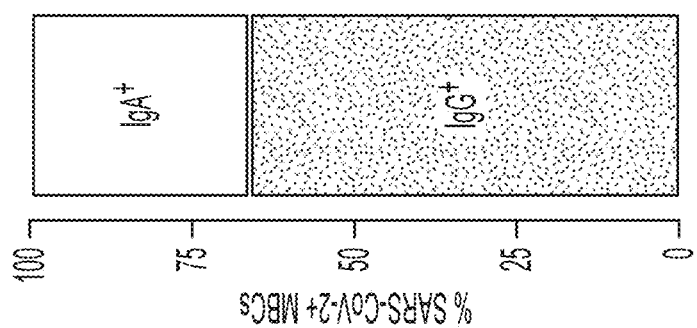
Figure 6D:
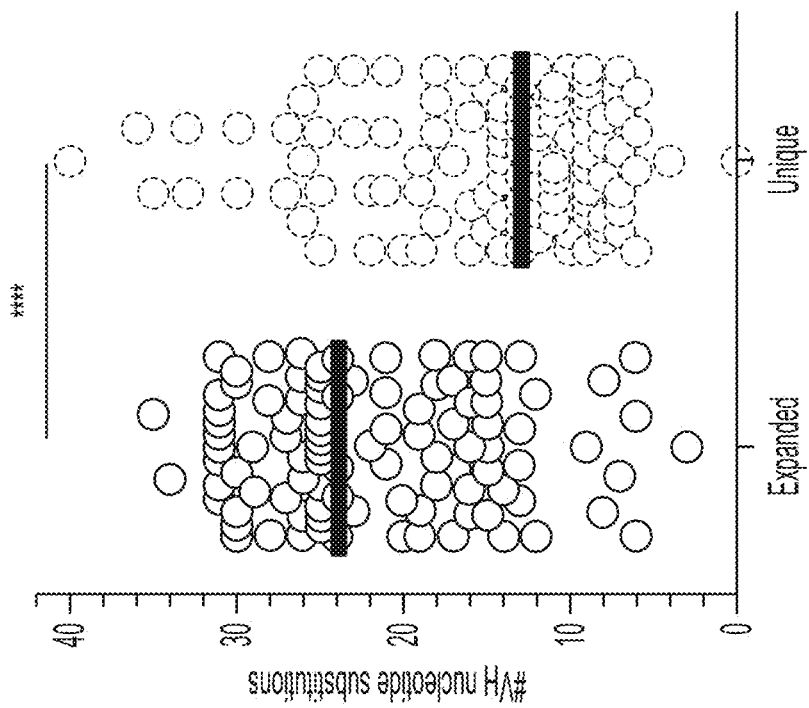
Figure 6C:
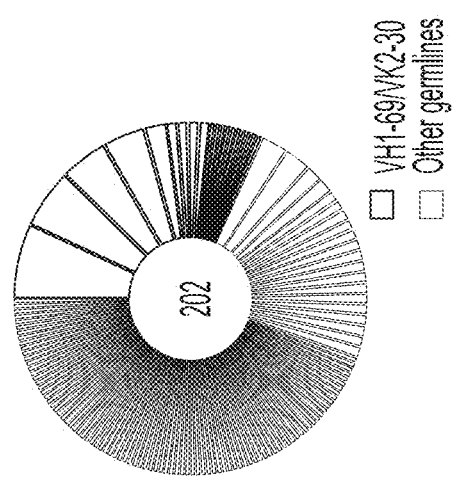
Figure 13D:
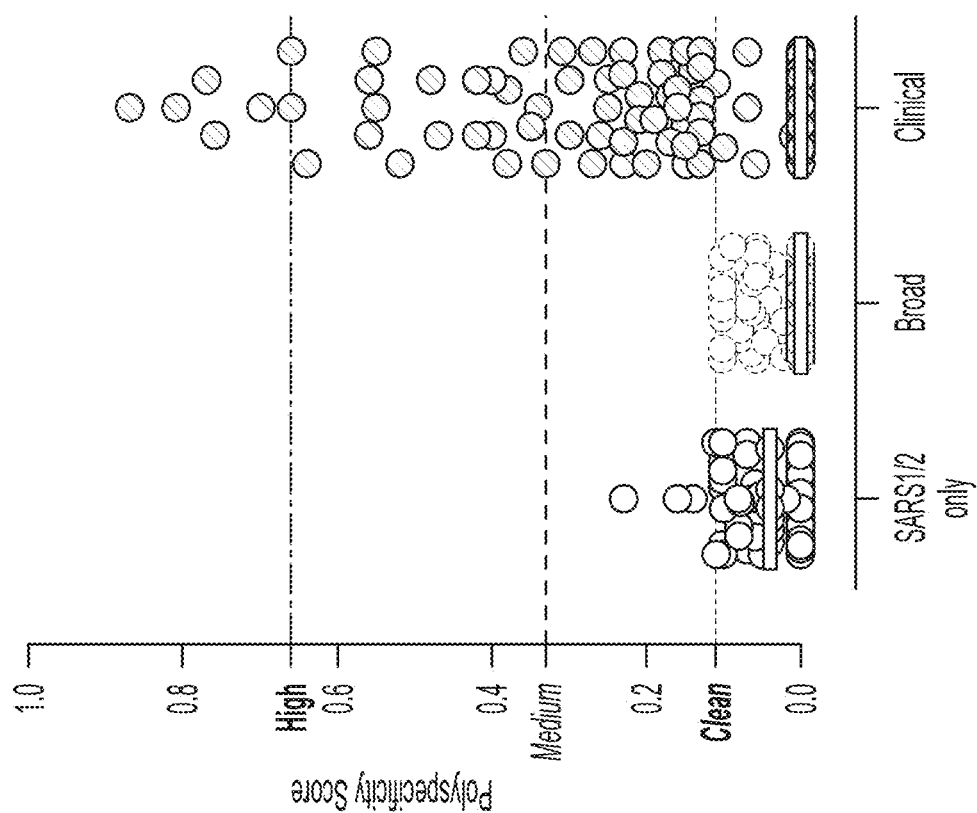
FIG. 13D provides polyspecificity of broadly cross-reactive ("Broad") and SARS-CoV/SARS-CoV-2-specific ("SARS1/2 only") antibodies, as determined using a previously described assay (Xu et al., *Protein Engineering, Design and Selection* 26(10), 663-670 (2013)). Thresholds for high, medium, low, and no polyspecificity are indicated by dashed lines. Polyspecificity scores for 138 clinical antibodies are shown for comparison (Jain et al., *PNAS* 1114(5), 944-949 (2017).

It is to be understood that this disclosure is not limited to the particular methodology, protocols, cell lines, animal species or genera, and reagents described, as such may vary. It is also to be understood that the terminology used herein is for the purpose of describing particular embodiments only and is not intended to limit the scope of the present disclosure, which will be limited only by the appended claims. As used herein the singular forms "a", "and", and "the" include plural referents unless the context clearly dictates otherwise. Thus, for example, reference to "a cell" includes a plurality of such cells and reference to "the protein" includes reference to one or more proteins and equivalents thereof known to those skilled in the art, and so forth. All technical and scientific terms used herein have the same meaning as commonly understood to one of ordinary skill in the art to which this disclosure belongs unless clearly indicated otherwise.

Spike protein (S protein): As used herein, unless stated otherwise S protein includes any coronavirus form of S protein. The term coronavirus S protein ("CoV-S") is used to describe the S protein of any coronaviruses. In particular, the "SARS-CoV-S" and "SARS-CoV-2-S" encompass the S protein of SARS-CoV and of SARS-CoV-2. SEQ ID NO: 1 is an exemplary polypeptide sequence of SARS-CoV-S, comprising 1288 amino acids (Accession #PDB: 6VSB_B). SEQ ID NO: 5 is an exemplary polypeptide sequence of SARS-CoV-2-S, comprising 1273 amino acids (GenBank: QHD43416.1). SEQ ID NO: 2 (3864 nucleotides) encodes the SARS-CoV-S(SEQ ID NO: 1) and SEQ ID NO: 6 (3822 nucleotides, NC_045512:21563.25384, also see the corresponding region of GenBank: MN908947) encodes SARS-CoV-2-S(SEQ ID NO: 5).

In some embodiments, the "SARS-CoV-S" and "SARS-CoV-2-S" encompass any mutants, splice variants, isoforms, orthologs, homologs, and variants of SEQ ID Nos 1 and 5. In some embodiments, the CoV-S comprises a polypeptide sequence having at least 85%, 90%, 95%, 96%, 97%, 98%, or 99% identity to either SEQ ID NO:1 or SEQ ID NO:5.

"Effective treatment or prevention of CoV infection" herein refers to eliminating CoV from the subject or preventing the expansion of CoV in the subject or eliminating or reducing the symptoms such as fever, cough, shortness of breath, runny nose, congestion, conjunctivitis, and/or gastrointestinal symptoms after administration of an effective amount of an anti-CoV-S antibody or antigen-binding fragment thereof. In some instances, effective treatment may eliminate the need for the subject to be placed on a ventilator or reduce the time the subject needs to be on a ventilator. The treatment may be effected as a monotherapy or in association with another active agent such as an antiviral agent or anti-inflammatory agent by way of example.

As used herein, "treatment" is an approach for obtaining beneficial or desired clinical results. For purposes of this disclosure, beneficial or desired clinical results include, but are not limited to, one or more of the following: improvement in any aspect of COV-S-related conditions such as fever or cough. For example, in the context of CoV infection treatment this includes lessening severity, alleviation of fever, cough, shortness of breath, and other associated symptoms, reducing frequency of recurrence, increasing the quality of life of those suffering from the CoV-related symptoms, and decreasing dose of other medications required to treat the CoV-related symptoms. Other associated symptoms include, but are not limited to, diarrhea, conjunctivitis, loss of smell, and loss of taste. Still other symptoms which may be alleviated or prevented include inflammation, cytokine storm and/or sepsis.

"Reducing incidence" or "prophylaxis" or "prevention" means any of reducing severity for a particular disease, condition, symptom, or disorder (the terms disease, condition, and disorder are used interchangeably throughout the application). Reduction in severity includes reducing drugs and/or therapies generally used for the condition by, for example, reducing the need for, amount of, and/or exposure to drugs or therapies. Reduction in severity also includes reducing the duration, and/or frequency of the particular condition, symptom, or disorder (including, for example, delaying or increasing time to next episodic attack in an individual). This further includes eliminating the need for the subject to be placed on a ventilator or reducing the time the subject needs to be on a ventilator.

"Ameliorating" one or more symptoms of CoV infection-related conditions means a lessening or improvement of one or more symptoms of the condition, e.g., fever or cough or shortness of breath as compared to not administering an anti-CoV-S antagonist antibody. "Ameliorating" also includes shortening or reduction in duration of a symptom. Again, this may include eliminating the need for the subject to be placed on a ventilator or reducing the time the subject needs to be on a ventilator.

As used herein, "controlling CoV-related symptom" or "controlling" another CoV-S-related condition refers to maintaining or reducing severity or duration of one or more symptoms of the condition (as compared to the level before treatment). For example, the duration or severity or frequency of symptoms is reduced by at least about any of 10%, 20%, 30%, 40%, 50%, 60%, 70%, 80%, 90%, or 100% in the individual as compared to the level before treatment. The reduction in the duration or severity, or frequency of symptoms can last for any length of time, e.g., 2 weeks, 4 weeks (1 month), 8 weeks (2 months), 16 weeks (3 months), 4 months, 5 months, 6 months, 9 months, 12 months, etc.

As used therein, "delaying" the development of a CoV-S-related condition such as shortness of breath, bronchitis, or pneumonia e.g., interstitial), means to defer, hinder, slow, retard, stabilize, and/or postpone progression of the condition or disease. This delay can be of varying lengths of time, depending on the history of the condition or disease and/or individuals being treated. As is evident to one skilled in the art, a sufficient or significant delay can, in effect, encompass prevention, in that the individual does not develop symptoms. A method that "delays" development of the symptom is a method that reduces probability of developing the symptom in a given time frame and/or reduces extent of the symptoms in a given time frame, when compared to not using the method. Such comparisons are typically based on clinical studies, using a statistically significant number of subjects.

"Development" or "progression" of a CoV-related condition such as cough or fever means initial manifestations and/or ensuing progression of the disorder. Development of cough or fever can be detectable and assessed using standard clinical techniques as well known in the art. However, development also refers to progression that may be undetectable. For purpose of this disclosure, development, or progression refers to the biological course of the symptoms. "Development" includes occurrence, recurrence, and onset. As used herein "onset" or "occurrence" of a condition includes initial onset and/or recurrence.

As used herein, an "effective dosage" or "effective amount" of drug, compound, or pharmaceutical composition is an amount sufficient to effect beneficial or desired results. For prophylactic use, beneficial or desired results include results such as eliminating or reducing the risk, lessening the severity, or delaying the outset of the disease, including biochemical, histological, and/or behavioral symptoms of the disease, its complications and intermediate pathological phenotypes presenting during development of the disease. For therapeutic use, beneficial or desired results include clinical results such as reducing symptom intensity, duration, or frequency, and decreasing one or more symptoms resulting from CoV infection, including its complications and intermediate pathological phenotypes presenting during development of the disease, increasing the quality of life of those suffering from the disease, decreasing the dose of other medications required to treat the disease, enhancing effect of another medication, and/or delaying the progression of the disease of patients, eliminating the need for the subject to be placed on a ventilator or reducing the time the subject needs to be on a ventilator.

An effective dosage can be administered in one or more administrations. For purposes of this disclosure, an effective dosage of drug, compound, or pharmaceutical composition is an amount sufficient to accomplish prophylactic or therapeutic treatment either directly or indirectly. As is understood in the clinical context, an effective dosage of a drug, compound, or pharmaceutical composition may or may not be achieved in conjunction with another drug, compound, or pharmaceutical composition. Thus, an "effective dosage" may be considered in the context of administering one or more therapeutic agents, and a single agent may be considered to be given in an effective amount if, in conjunction with one or more other agents, a desirable result may be or is achieved.

A "suitable host cell" or "host cell" generally includes any cell wherein the subject anti-CoV-S antibodies and antigen-binding fragments thereof can be produced recombinantly using techniques and materials readily available. For example, the anti-CoV-S antibodies and antigen-binding fragments thereof of the present disclosure can be produced in genetically engineered host cells according to conventional techniques. Suitable host cells are those cell types that can be transformed or transfected with exogenous DNA and grown in culture, and include bacteria, fungal cells (e.g., yeast), and cultured higher eukaryotic cells (including cultured cells of multicellular organisms), particularly cultured mammalian cells, e.g., human or non-human mammalian cells. In an exemplary embodiment these antibodies may be expressed in CHO cells. Techniques for manipulating cloned DNA molecules and introducing exogenous DNA into a variety of host cells are disclosed by Sambrook et al., *Molecular Cloning: A Laboratory Manual*, 2nd ed., Cold Spring Harbor, N.Y.: Cold Spring Harbor Laboratory Press (1989), and *Current Protocols in Molecular Biology*, Ausubel et al., editors, New York, N.Y.: Green and Wiley and Sons (1993).

In some exemplary embodiments the antibodies may be expressed in mating competent yeast, e.g., any haploid, diploid or tetraploid yeast that can be grown in culture. Yeast useful in fermentation expression methods may exist in a haploid, diploid, or other polyploid form.

A "selectable marker" herein refers to a gene or gene fragment that confers a growth phenotype (physical growth characteristic) on a cell receiving that gene as, for example through a transformation event. The selectable marker allows that cell to survive and grow in a selective growth medium under conditions in which cells that do not receive that selectable marker gene cannot grow. Selectable marker genes generally fall into several types, including positive selectable marker genes such as a gene that confers on a cell resistance to an antibiotic or other drug, temperature when two temperature sensitive ("ts") mutants are crossed or a ts mutant is transformed; negative selectable marker genes such as a biosynthetic gene that confers on a cell the ability to grow in a medium without a specific nutrient needed by all cells that do not have that biosynthetic gene, or a mutagenized biosynthetic gene that confers on a cell inability to grow by cells that do not have the wild type gene; and the like.

An "expression vector" herein refers to DNA vectors containing elements that facilitate manipulation for the expression of a foreign protein within the target host cell, e.g., a bacterial, insect, yeast, plant, amphibian, reptile, avian, or mammalian cell, e.g., a CHO or HEK cell. Conveniently, manipulation of sequences and production of DNA for transformation may first performed in a bacterial host, e.g. *E. coli*, and usually vectors will include sequences to facilitate such manipulations, including a bacterial origin of replication and appropriate bacterial selection marker. Selection markers encode proteins necessary for the survival or growth of transformed host cells grown in a selective culture medium. Host cells not transformed with the vector containing the selection gene will not survive in the culture medium. Typical selection genes encode proteins that (a) confer resistance to antibiotics or other toxins, (b) complement auxotrophic deficiencies, or (c) supply critical nutrients not available from complex media. Exemplary vectors and methods for transformation of yeast are described, for example, in Burke, D., Dawson, D., & Stearns, T., *Methods in yeast genetics: a Cold Spring Harbor Laboratory course manual*, Plainview, N.Y.: Cold Spring Harbor Laboratory Press (2000). Expression vectors for use in the methods of the disclosure may include yeast or mammalian specific sequences, including a selectable auxotrophic or drug marker for identifying transformed host strains. A drug marker may further be used to amplify copy number of the vector in a yeast host cell.

The polypeptide coding sequence of interest is operably linked to transcriptional and translational regulatory sequences that provide for expression of the polypeptide in the desired host cells, e.g., yeast or mammalian cells. These vector components may include, but are not limited to, one or more of the following: an enhancer element, a promoter, and a transcription termination sequence. Sequences for the secretion of the polypeptide may also be included, e.g. a signal sequence, and the like. An origin of replication, e.g., a yeast or mammalian origin of replication, is optional, as expression vectors may be integrated into the host cell genome.

Nucleic acids are "operably linked" when placed into a functional relationship with another nucleic acid sequence. For example, DNA for a signal sequence is operably linked to DNA for a polypeptide if it is expressed as a preprotein that participates in the secretion of the polypeptide; a promoter or enhancer is operably linked to a coding sequence if it affects the transcription of the sequence. Generally, "operably linked" means that the DNA sequences being linked are contiguous, and, in the case of a secretory leader, contiguous and in reading frame. However, enhancers do not have to be contiguous Linking is accomplished by ligation at convenient restriction sites or via a PCR/recombination method familiar to those skilled in the art (GATE-WAY® Technology (universal method for cloning DNA); Invitrogen, Carlsbad Calif.). If such sites do not exist, the synthetic oligonucleotide adapters or linkers are used in accordance with conventional practice.

Promoters are untranslated sequences located upstream (5) to the start codon of a structural gene (generally within about 100 to 1000 bp) that control the transcription and translation of particular nucleic acid sequences to which they are operably linked. Such promoters fall into several classes: inducible, constitutive, and repressible promoters (that increase levels of transcription in response to absence of a repressor). Inducible promoters may initiate increased levels of transcription from DNA under their control in response to some change in culture conditions, e.g., the presence or absence of a nutrient or a change in temperature.

The promoter fragment may also serve as the site for homologous recombination and integration of the expression vector into the same site in the host cell, e.g., yeast or mammalian cell, genome; alternatively, a selectable marker may be used as the site for homologous recombination. Suitable promoters for use in different eukaryotic and prokaryotic cells are well known and commercially available.

The polypeptides of interest may be produced recombinantly not only directly, but also as a fusion polypeptide with a heterologous polypeptide, e.g. a signal sequence or other polypeptide having a specific cleavage site at the N-terminus of the mature protein or polypeptide. In general, the signal sequence may be a component of the vector, or it may be a part of the polypeptide coding sequence that is inserted into the vector. The heterologous signal sequence selected preferably is one that is recognized and processed through one of the standard pathways available within the host cell, e.g., a mammalian cell, an insect cell, or a yeast cell. Additionally, these signal peptide sequences may be engineered to provide for enhanced secretion in expression systems. Secretion signals of interest also include mammalian and yeast signal sequences, which may be heterologous to the protein being secreted, or may be a native sequence for the protein being secreted. Signal sequences include pre-peptide sequences, and in some instances may include propeptide sequences. Many such signal sequences are known in the art, including the signal sequences found on immunoglobulin chains, e.g., K28 preprotoxin sequence, PHA-E, FACE, human MCP-1, human serum albumin signal sequences, human Ig heavy chain, human Ig light chain, and the like.

For example, see Hashimoto et. al., *Protein Eng.*, 11(2):75 (1998); and Kobayashi et. al., *Therapeutic Apheresis*, 2(4): 257 (1998)).

Transcription may be increased by inserting a transcriptional activator sequence into the vector. These activators are cis-acting elements of DNA, usually about from 10 to 300 bp, which act on a promoter to increase its transcription. Transcriptional enhancers are relatively orientation and position independent, having been found 5' and 3' to the transcription unit, within an intron, as well as within the coding sequence itself. The enhancer may be spliced into the expression vector at a position 5' or 3' to the coding sequence, but is preferably located at a site 5' from the promoter.

Expression vectors used in eukaryotic host cells may also contain sequences necessary for the termination of transcription and for stabilizing the mRNA. Such sequences are commonly available from 3' to the translation termination codon, in untranslated regions of eukaryotic or viral DNAs or cDNAs. These regions contain nucleotide segments transcribed as polyadenylated fragments in the untranslated portion of the mRNA.

Construction of suitable vectors containing one or more of the above-listed components employs standard ligation techniques or PCR/recombination methods. Isolated plasmids or DNA fragments are cleaved, tailored, and re-ligated in the form desired to generate the plasmids required or via recombination methods. For analysis to confirm correct sequences in plasmids constructed, the ligation mixtures are used to transform host cells, and successful transformants selected by antibiotic resistance (e.g. ampicillin or Zeocin) where appropriate. Plasmids from the transformants are prepared, analyzed by restriction endonuclease digestion, and/or sequenced.

As an alternative to restriction and ligation of fragments, recombination methods based on specific attachment ("att") sites and recombination enzymes may be used to insert DNA sequences into a vector. Such methods are described, for example, by Landy, *Ann. Rev. Biochem.*, 58:913-949 (1989); and are known to those of skill in the art. Such methods utilize intermolecular DNA recombination that is mediated by a mixture of lambda and *E. coli*-encoded recombination proteins. Recombination occurs between att sites on the interacting DNA molecules. For a description of att sites see Weisberg and Landy, *Site-Specific Recombination in Phage Lambda*, in Lambda II, p. 211 250, Cold Spring Harbor, N.Y.: Cold Spring Harbor Press (1983). The DNA segments flanking the recombination sites are switched, such that after recombination, the att sites are hybrid sequences comprised of sequences donated by each parental vector. The recombination can occur between DNAs of any topology.

Att sites may be introduced into a sequence of interest by ligating the sequence of interest into an appropriate vector; generating a PCR product containing att B sites through the use of specific primers; generating a cDNA library cloned into an appropriate vector containing att sites; and the like.

Folding, as used herein, refers to the three-dimensional structure of polypeptides and proteins, where interactions between amino acid residues act to stabilize the structure. While non-covalent interactions are important in determining structure, usually the proteins of interest will have intra- and/or intermolecular covalent disulfide bonds formed by two cysteine residues. For naturally occurring proteins and polypeptides or derivatives and variants thereof, the proper folding is typically the arrangement that results in optimal biological activity, and can conveniently be monitored by assays for activity, e.g. ligand binding, enzymatic activity, etc.

In some instances, for example where the desired product is of synthetic origin, assays based on biological activity will be less meaningful. The proper folding of such molecules may be determined on the basis of physical properties, energetic considerations, modeling studies, etc.

The expression host may be further modified by the introduction of sequences encoding one or more enzymes that enhance folding and disulfide bond formation, i.e. foldases, chaperonins, etc. Such sequences may be constitutively or inducibly expressed in the host cell, using vectors, markers, etc. as known in the art. Preferably the sequences, including transcriptional regulatory elements sufficient for the desired pattern of expression, are stably integrated in the yeast genome through a targeted methodology.

For example, the eukaryotic protein disulfide isomerase ("PDI") is not only an efficient catalyst of protein cysteine oxidation and disulfide bond isomerization, but also exhibits chaperone activity. Co-expression of PDI can facilitate the production of active proteins having multiple disulfide bonds. Also of interest is the expression of immunoglobulin heavy chain binding protein ("BIP"); cyclophilin; and the like.

Cultured mammalian cells are exemplary hosts for production of the disclosed anti-CoV-S antibodies and antigen-binding fragments thereof. As mentioned CHO cells are particularly suitable for expression of antibodies. Many procedures are known in the art for manufacturing monoclonal antibodies in mammalian cells. (See, Galfre, G. and Milstein, C., *Methods Enzym.,* 73:3-46, 1981; Basalp et al., *Turk. J. Biol.,* 24:189-196, 2000; Wurm, F. M., *Nat. Biotechnol.,* 22:1393-1398, 2004; and Li et al., *mAbs,* 2(5):466-477, 2010). As mentioned in further detail infra, common host cell lines employed in mammalian monoclonal antibody manufacturing schemes include, but are not limited to, human embryonic retinoblast cell line PER.C6® (Crucell N. V., Leiden, The Netherlands), NS0 murine myeloma cells (Medical Research Council, London, UK), CV1 monkey kidney cell line, 293 human embryonic kidney cell line, BHK baby hamster kidney cell line, VERO African green monkey kidney cell line, human cervical carcinoma cell line HELA, MDCK canine kidney cells, BRL buffalo rat liver cells, W138 human lung cells, HepG2 human liver cells, MMT mouse mammary tumor cells, TRI cells, MRCS cells, Fs4 cells, myeloma or lymphoma cells, or Chinese Hamster (*Cricetulus griseus*) Ovary (CHO) cells, and the like. Many different subclones or sub-cell lines of CHO cells known in the art that are useful and optimized for production of recombinant monoclonal antibodies, such as the DP12 (CHO K1 dhfr-) cell line, NS0 cells are a non-Ig secreting, non-light chain-synthesizing subclone of NS-1 cells that are resistant to azaguanine. Other Chinese Hamster and CHO cells are commercially available (from ATCC, etc.), including CHO-DXB11 (CHO-DUKX), CHO-pro3, CHO-DG44, CHO 1-15, CHO DP-12, Lec2, M1WT3, Lec8, pgsA-745, and the like, all of which are genetically altered to optimize the cell line for various parameters. Monoclonal antibodies are commonly manufactured using a batch fed method whereby the monoclonal antibody chains are expressed in a mammalian cell line and secreted into the tissue culture medium in a bioreactor. Medium (or feed) is continuously supplied to the bioreactor to maximize recombinant protein expression. Recombinant monoclonal antibody is then purified from the collected media. In some circumstances, additional steps are needed to reassemble the antibodies through reduction of disulfide bonds, etc. Such production methods can be scaled to be as large as 10,000 L in a single batch or more. It is now routine to obtain as much as 20 pg/cell/day through the use of such cell lines and methodologies, providing titers as high as 10 g/L or more, amounting to 15 to 100 kg from bioreactors of 10 kL to 25 kL. (Li et al., 2010). Various details of this production methodology, including cloning of the polynucleotides encoding the antibodies into expression vectors, transfecting cells with these expression vectors, selecting for transfected cells, and expressing and purifying the recombinant monoclonal antibodies from these cells are provided below.

For recombinant production of an anti-CoV-S antibody or antigen-binding fragment in mammalian cells, nucleic acids encoding the antibody or fragment thereof are generally inserted into a replicable vector for further cloning (amplification of the DNA) or for expression. DNA encoding the antibody is readily isolated or synthesized using conventional procedures (e.g., by using oligonucleotide probes that are capable of binding specifically to DNAs encoding the heavy and light chains of the antibody). The vector components generally include, but are not limited to, one or more of the following: a signal sequence, an origin of replication, one or more marker genes, an enhancer element, a promoter, and a transcription termination sequence. Selection of promoters, terminators, selectable markers, vectors, and other elements is a matter of routine design within the level of ordinary skill in the art. Many such elements are known in the art and are available through commercial suppliers.

The antibodies of this disclosure may be produced recombinantly not only directly, but also as a fusion polypeptide with a heterologous polypeptide, which is preferably a signal sequence or other polypeptide having a specific cleavage site at the N-terminus of the mature protein or polypeptide. The homologous or heterologous signal sequence selected preferably is one that is recognized and processed (i.e., cleaved by a signal peptidase) by the host cell. In mammalian cell expression, mammalian signal sequences as well as viral secretory leaders, for example, the herpes simplex gD signal, are available.

Such expression vectors and cloning vectors will generally contain a nucleic acid sequence that enables the vector to replicate in one or more selected host cells. Typically, in cloning vectors this sequence is one that enables the vector to replicate independently of the host chromosomal DNA, and includes origins of replication or autonomously replicating sequences. Such sequences are well known for a variety of bacteria, yeast, and viruses, e.g., the origin of replication from the plasmid pBR322 is suitable for most Gram-negative bacteria, the 2mu plasmid origin is suitable for yeast, and various viral origins (Simian Virus 40 ("SV40"), polyoma, adenovirus, vesicular stomatitis virus ("VSV"), or bovine papillomavirus ("BPV") are useful for cloning vectors in mammalian cells. Generally, the origin of replication component is not needed for mammalian expression vectors (the SV40 origin may typically be used only because it contains the early promoter).

These vectors will also typically contain a selection gene, also termed a selectable marker. Typical selection genes encode proteins that (a) confer resistance to antibiotics or other toxins, e.g., ampicillin, neomycin, methotrexate, or tetracycline, (b) complement auxotrophic deficiencies, or (c) supply critical nutrients not available from complex media, e.g., the gene encoding D-alanine racemase for Bacilli.

One example of a selection scheme utilizes a drug to arrest growth of a host cell. Drug selection is generally used to select for cultured mammalian cells into which foreign DNA has been inserted. Such cells are commonly referred to as "transfectants". Cells that have been cultured in the presence of the selective agent and are able to pass the gene of interest to their progeny are referred to as "stable transfectants." Examples of such dominant selection use the drugs neomycin, mycophenolic acid, and hygromycin. An exemplary selectable marker is a gene encoding resistance to the antibiotic neomycin. Selection is carried out in the presence of a neomycin-type drug, such as G-418 or the like. Those cells that are successfully transformed with a heterologous gene produce a protein conferring drug resistance and thus survive the selection regimen.

Selection systems can also be used to increase the expression level of the gene of interest, a process referred to as "amplification." Amplification of transfectants typically occurs by culturing the cells in the presence of a low level of the selective agent and then increasing the amount of selective agent to select for cells that produce high levels of the products of the introduced genes. Exemplary suitable selectable markers for mammalian cells are those that enable the identification of cells competent to take up the antibody nucleic acid, such as dihydrofolate reductase ("DHFR"), thymidine kinase, metallothionein-I and —II, preferably primate metallothionein genes, adenosine deaminase, ornithine decarboxylase, etc.

For example, an amplifiable selectable marker for mammalian cells is dihydrofolate reductase, which confers resistance to methotrexate. Other drug resistance genes (e.g. hygromycin resistance, multi-drug resistance, puromycin acetyltransferase) can also be used. Cells transformed with the DHFR selection gene are first identified by culturing all of the transformants in a culture medium that contains methotrexate ("MTX"), a competitive antagonist of DHFR. An appropriate host cell when wild-type DHFR is employed is the Chinese hamster ovary ("CHO") cell line deficient in DHFR activity.

Alternatively, host cells (particularly wild-type hosts that contain endogenous DHFR) transformed or co-transformed with DNA sequences encoding antibody, wild-type DHFR protein, and another selectable marker such as aminoglycoside 3'-phosphotransferase ("APH") can be selected by cell growth in medium containing a selection agent for the selectable marker such as an aminoglycosidic antibiotic, e.g., kanamycin, neomycin, or G-418. See U.S. Pat. No. 4,965,199.

These vectors may comprise an enhancer sequence that facilitates transcription of a DNA encoding the antibody. Many enhancer sequences are known from mammalian genes (for example, globin, elastase, albumin, alpha-fetoprotein, and insulin). A frequently used enhancer is one derived from a eukaryotic cell virus. Examples thereof include the SV40 enhancer on the late side of the replication origin (bp 100-270), the cytomegalovirus early promoter enhancer, the polyoma enhancer on the late side of the replication origin, and adenovirus enhancers (See also Yaniv, Nature, 297:17 18 (1982) on enhancing elements for activation of eukaryotic promoters). The enhancer may be spliced into the vector at a position 5' or 3' to the antibody-encoding sequence, but is preferably located at a site 5' from the promoter.

Expression and cloning vectors will also generally comprise a promoter that is recognized by the host organism and is operably linked to the antibody nucleic acid. Promoter sequences are known for eukaryotes. Virtually all eukaryotic genes have an AT-rich region located approximately 25 to 30 bases upstream from the site where transcription is initiated. Another sequence found 70 to 80 bases upstream from the start of transcription of many genes is a CNCAAT region where N may be any nucleotide. At the 3' end of most eukaryotic genes is an AATAAA sequence that may be the signal for addition of the poly A tail to the 3' end of the coding sequence. All of these sequences are suitably inserted into eukaryotic expression vectors.

Antibody transcription from vectors in mammalian host cells may be controlled, for example, by promoters obtained from the genomes of viruses such as polyoma virus, fowlpox virus, adenovirus (such as Adenovirus 2), BPV, avian sarcoma virus, cytomegalovirus, a retrovirus, hepatitis-B virus, and most preferably SV40, from heterologous mammalian promoters, e.g., the actin promoter or an immunoglobulin promoter, from heat-shock promoters, provided such promoters are compatible with the host cell systems.

The early and late promoters of the SV40 virus are conveniently obtained as an SV40 restriction fragment that also contains the SV40 viral origin of replication. The immediate early promoter of the human cytomegalovirus is conveniently obtained as a HindIII E restriction fragment. A system for expressing DNA in mammalian hosts using the BPV as a vector is disclosed in U.S. Pat. No. 4,419,446. A modification of this system is described in U.S. Pat. No. 4,601,978. See also Reyes et al., Nature, 297:598-601 (1982) on expression of human beta-interferon cDNA in mouse cells under the control of a thymidine kinase promoter from herpes simplex virus. Alternatively, the Rous sarcoma virus long terminal repeat can be used as the promoter.

Strong transcription promoters can be used, such as promoters from SV40, cytomegalovirus, or myeloproliferative sarcoma virus. See, e.g., U.S. Pat. No. 4,956,288 and U.S. Patent Publication No. 20030103986. Other suitable promoters include those from metallothionein genes (U.S. Pat. Nos. 4,579,821 and 4,601,978) and the adenovirus major late promoter. Expression vectors for use in mammalian cells include pZP-1, pZP-9, and pZMP21, which have been deposited with the American Type Culture Collection, 10801 University Blvd., Manassas, Va. USA under accession numbers 98669, 98668, and PTA-5266, respectively, and derivatives of these vectors.

Expression vectors used in eukaryotic host cells (yeast, fungus, insect, plant, animal, human, or a nucleated cell from other multicellular organism) will also generally contain sequences necessary for the termination of transcription and for stabilizing the mRNA. Such sequences are commonly available from the 5' and, occasionally 3', untranslated regions of eukaryotic or viral DNAs or cDNAs. These regions contain nucleotide segments transcribed as polyadenylated fragments in the untranslated portion of the mRNA encoding the antibody. One useful transcription termination component is the bovine growth hormone polyadenylation region. See WO 94/11026 and the expression vector disclosed therein.

Suitable host cells for cloning or expressing the subject antibodies include prokaryote, yeast, or higher eukaryote cells described above. However, interest has been greatest in vertebrate cells, and propagation of vertebrate cells in culture has become a routine procedure. Examples of useful mammalian host cell lines are monkey kidney CV1 line transformed by SV40 (COS-1 (ATCC No. CRL 1650); and COS-7, ATCC CRL 1651); human embryonic kidney line (293 or 293 cells subcloned for growth in suspension culture, (ATCC No. CRL 1573; Graham et al., J. Gen. Virol., 36:59-72 (1977)); baby hamster kidney cells (BHK, ATCC CCL 10, ATCC No. CRL 1632; BHK 570, ATCC No. CRL 10314); CHO cells (CHO-K1, ATCC No. CCL 61; CHO-DG44, Urlaub et al., *Proc. Natl. Acad. Sci. USA,* 77:4216-4220 (1980)); mouse sertoli cells (TM4, Mather, *Biol. Reprod.,* 23:243-251 (1980)); monkey kidney cells (CV1 ATCC CCL 70); African green monkey kidney cells (VERO-76, ATCC CRL-1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2, HB 8065); mouse mammary tumor (MMT 060562, ATCC CCL51); TRI cells (Mather et al., *Annals N.Y. Acad. Sci.,* 383:44-68 (1982)); MRC 5 cells; FS4 cells; and a human hepatoma line (Hep G2). Additional suitable cell lines are known in the art and available from public depositories such as the American Type Culture Collection, Manassas, Va.

Host cells are transformed with the above-described expression or cloning vectors for antibody production and cultured in conventional nutrient media modified as appropriate for inducing promoters, selecting transformants, or amplifying the genes encoding the desired sequences as discussed supra.

The mammalian host cells used to produce the antibody of this disclosure may be cultured in a variety of media. Commercially available media such as Ham's F10 (Sigma-Aldrich Corporation, St. Louis, Mo.), Minimal Essential Medium (("MEM" (Sigma-Aldrich Corporation, St. Louis, Mo.), Roswell Park Memorial Institute-1640 medium ("RPMI-1640", Sigma-Aldrich Corporation, St. Louis, Mo.), and Dulbecco's Modified Eagle's Medium (("DMEM" Sigma-Aldrich Corporation, St. Louis, Mo.) are suitable for culturing the host cells. In addition, any of the media described in Ham et al., *Meth. Enz.,* 58:44 (1979), Barnes et al., *Anal. Biochem.,* 102:255 (1980), U.S. Pat. Nos. 4,767,704; 4,657,866; 4,927,762; 4,560,655; or 5,122,469; WO 90/03430; WO 87/00195; or U.S. patent Reexam No. 30,985 can be used as culture media for the host cells. Any of these media may be supplemented as necessary with hormones and/or other growth factors (such as insulin, transferrin, or epidermal growth factor), salts (such as sodium chloride, calcium, magnesium, and phosphate), buffers (such as HEPES), nucleotides (such as adenosine and thymidine), antibiotics (such as Gentamycin drug), trace elements (defined as inorganic compounds usually present at final concentrations in the micromolar range), and glucose or an equivalent energy source. Any other necessary supplements may also be included at appropriate concentrations that would be known to those skilled in the art. The culture conditions, such as temperature, pH, and the like, are those previously used with the host cell selected for expression, and will be apparent to the ordinarily skilled artisan. Methods of development and optimization of media and culture conditions are known in the art (See, Gronemeyer et al., *Bioengineering,* 1(4):188-212, 2014).

After culture conditions are optimized and a preferred cell line clone is selected, these cells are cultured (either adherent cells or suspension cultures) most typically in a batch-fed process in a bioreactor (many models are commercially available) that involves continuously feeding the cell culture with medium and feed, optimized for the particular cell line chosen and selected for this purpose. (See, Butler, M., *Appl. Microbiol. Biotechnol.,* 68:283-291, 2005; and Kelley, B., *mAb,* 1(5):443-452, 2009). Perfusion systems are also available in which media and feed are continuously supplied to the culture while the same volume of media is being withdrawn from the bioreactor. (Wurm, 2004). Synthetic media, also commercially available, are available for growing cells in a batch-fed culture, avoiding the possibility of contamination from outside sources, such as with the use of animal components, such as bovine serum albumin, etc. However, animal-component-free hydrolysates are commercially available to help boost cell density, culture viability and productivity. (Li et al., 2010). Many studies have been performed in an effort to optimize cell culture media, including careful attention to head space available in roller bottles, redox potentials during growth and expression phases, presence of reducing agents to maintain disulfide bonds during production, etc. (See, for instance, Hutterer et al., *mAbs,* 5(4):608-613, 2013; and Mullan et al., *BMC Proceed.,* 5(Suppl 8):P110, 2011). Various methodologies have been developed to address the possibility of harmful oxidation during recombinant monoclonal antibody production. (See, for example, U.S. Pat. No. 8,574,869). Cultured cells may be grown by feeding nutrients continuously or as separately administered amounts. Often various process parameters such as cell concentration, pH, temperature, $CO_2$, $dO_2$, osmolality, amount of metabolites such as glucose, lactate, glutamine and glutamate, and the like, are monitored by the use of probes during the cell growth either on-line by direct connection to calibrated analyzers or off-line by intervention of operators. The culturing step also typically involves ensuring that the cells growing in culture maintain the transfected recombinant genes by any means known in the art for cell selection.

Following fermentation, i.e., upon reaching maximum cell growth and recombinant protein expression, the culturing step is typically followed by a harvesting step, whereby the cells are separated from the medium and a harvested cell culture media is thereby obtained. (See, Liu et al., *mAbs,* 2(5):480-499, 2010). Typically, various purification steps, involving column chromatography and the like, follow culturing to separate the recombinant monoclonal antibody from cell components and cell culture media components. The exact purification steps needed for this phase of the production of recombinant monoclonal antibodies depends on the site of expression of the proteins, i.e., in the cytosol of the cells themselves, or the more commonly preferred route of protein excreted into the cell culture medium. Various cell components may be separated using techniques known in the art such as differential centrifugation techniques, gravity-based cell settling, and/or size exclusion chromatograph/filtration techniques that can include tangential flow micro-filtration or depth filtration. (See, Pollock et al., *Biotechnol. Bioeng.,* 110:206-219, 2013, and Liu et al., 2010). Centrifugation of cell components may be achieved on a large scale by use of continuous disk stack centrifuges followed by clarification using depth and membrane filters. (See, Kelley, 2009). Most often, after clarification, the recombinant protein is further purified by Protein A chromatography due to the high affinity of Protein A for the Fc domain of antibodies, and typically occurs using a low pH/acidification elution step (typically the acidification step is combined with a precautionary virus inactivation step). Flocculation and/or precipitation steps using acidic or cationic polyelectrolytes may also be employed to separate animal cells in suspension cultures from soluble proteins. (Liu et al., 2010). Lastly, anion- and cation-exchange chromatography, hydrophobic interaction chromatograph ("HIC"), hydrophobic charge induction chromatograph (HCIC), hydroxyapatite chromatography using ceramic hydroxyapatite $(Ca_5(PO_4)_3OH)_2$, and combinations of these techniques are typically used to polish the solution of recombinant monoclonal antibody. Final formulation and concentration of the desired monoclonal antibody may be achieved by use of ultracentrifugation techniques. Purification yields are typically 70 to 80%. (Kelley, 2009).

The terms "desired protein" or "desired antibody" herein are used interchangeably and refer generally to a parent antibody specific to a target, i.e., CoV-S or a chimeric or humanized antibody or a binding portion thereof derived therefrom as described herein. The term "antibody" is intended to include any polypeptide chain-containing molecular structure with a specific shape that fits to and recognizes an epitope, where one or more non-covalent binding interactions stabilize the complex between the molecular structure and the epitope. The archetypal antibody molecule is the immunoglobulin, and all types of immunoglobulins, IgG, IgM, IgA, IgE, IgD, etc., from all sources, e.g. human, rodent, rabbit, cow, sheep, pig, dog, other mammals, chicken, other avians, etc., are considered to be "antibodies." Examples thereof include chimeric antibodies, human antibodies and other non-human mammalian antibodies, humanized antibodies, single chain antibodies (such as scFvs), camelbodies, nanobodies, IgNAR (single-chain antibodies which may be derived from sharks, for example), small-modular immunopharmaceuticals ("SMIPs"), and antibody fragments such as Fabs, Fab', F(ab)$_2$, and the like (See Streltsov et al., *Protein Sci.*, 14(11):2901-9 (2005); Greenberg et al., *Nature*, 374(6518):168-73 (1995); Nuttall et al., *Mol. Immunol.*, 38(4):313-26 (2001); Hamers-Casterman et al., *Nature*, 363(6428):446-8 (1993); Gill et al., *Curr. Opin. Biotechnol.*, (6):653-8 (2006)).

For example, antibodies or antigen-binding fragments thereof may be produced by genetic engineering. In this technique, as with other methods, antibody-producing cells are sensitized to the desired antigen or immunogen. The messenger RNA isolated from antibody producing cells is used as a template to make cDNA using PCR amplification. A library of vectors, each containing one heavy chain gene and one light chain gene retaining the initial antigen specificity, is produced by insertion of appropriate sections of the amplified immunoglobulin cDNA into the expression vectors. A combinatorial library is constructed by combining the heavy chain gene library with the light chain gene library. This results in a library of clones that co-express a heavy and light chain (resembling the Fab fragment or antigen-binding fragment of an antibody molecule). The vectors that carry these genes are co-transfected into a host cell. When antibody gene synthesis is induced in the transfected host, the heavy and light chain proteins self-assemble to produce active antibodies that can be detected by screening with the antigen or immunogen.

Antibody coding sequences of interest include those encoded by native sequences, as well as nucleic acids that, by virtue of the degeneracy of the genetic code, are not identical in sequence to the disclosed nucleic acids, and variants thereof. Variant polypeptides can include amino acid ("aa") substitutions, additions, or deletions. The amino acid substitutions can be conservative amino acid substitutions or substitutions to eliminate non-essential amino acids, such as to alter a glycosylation site, or to minimize misfolding by substitution or deletion of one or more cysteine residues that are not necessary for function. Variants can be designed so as to retain or have enhanced biological activity of a particular region of the protein (e.g., a functional domain, catalytic amino acid residues, etc). Variants also include fragments of the polypeptides disclosed herein, particularly biologically active fragments and/or fragments corresponding to functional domains. Techniques for in vitro mutagenesis of cloned genes are known. Also included in the subject disclosure are polypeptides that have been modified using ordinary molecular biological techniques so as to improve their resistance to proteolytic degradation or to optimize solubility properties or to render them more suitable as a therapeutic agent.

Chimeric antibodies may be made by recombinant means by combining the VL and VH regions, obtained from antibody producing cells of one species with the constant light and heavy chain regions from another. Typically, chimeric antibodies utilize rodent or rabbit variable regions and human constant regions, in order to produce an antibody with predominantly human domains. The production of such chimeric antibodies is well known in the art, and may be achieved by standard means (as described, e.g., in U.S. Pat. No. 5,624,659, incorporated herein by reference in its entirety). It is further contemplated that the human constant regions of chimeric antibodies of the disclosure may be selected from IgG1, IgG2, IgG3, and IgG4 constant regions.

Humanized antibodies are engineered to contain even more human-like immunoglobulin domains, and incorporate only the complementarity determining regions of the animal-derived antibody. This is accomplished by carefully examining the sequence of the hyper-variable loops of the variable regions of the monoclonal antibody and fitting them to the structure of the human antibody chains. Although facially complex, the process is straightforward in practice. See, e.g., U.S. Pat. No. 6,187,287, incorporated fully herein by reference.

In addition to entire immunoglobulins (or their recombinant counterparts), immunoglobulin fragments comprising the epitope binding site (e.g., Fab', F(ab')$_2$, or other fragments) may be synthesized. "Fragment" or minimal immunoglobulins may be designed utilizing recombinant immunoglobulin techniques. For instance, "Fv" immunoglobulins for use in the present disclosure may be produced by synthesizing a fused variable light chain region and a variable heavy chain region. Combinations of antibodies are also of interest, e.g. diabodies, which comprise two distinct Fv specificities. In another embodiment, small molecule immunopharmaceuticals ("SMIPs"), camelbodies, nanobodies, and IgNAR are encompassed by immunoglobulin fragments.

Immunoglobulins and fragments thereof may be modified post-translationally, e.g. to add effector moieties such as chemical linkers, detectable moieties, such as fluorescent dyes, enzymes, toxins, substrates, bioluminescent materials, radioactive materials, chemiluminescent moieties, and the like, or specific binding moieties, such as streptavidin, avidin, or biotin, and the like may be utilized in the methods and compositions of the present disclosure. Examples of additional effector molecules are provided infra.

A polynucleotide sequence "corresponds" to a polypeptide sequence if translation of the polynucleotide sequence in accordance with the genetic code yields the polypeptide sequence (i.e., the polynucleotide sequence "encodes" the polypeptide sequence), one polynucleotide sequence "corresponds" to another polynucleotide sequence if the two sequences encode the same polypeptide sequence.

A "heterologous" region or domain of a DNA construct is an identifiable segment of DNA within a larger DNA molecule that is not found in association with the larger molecule in nature. Thus, when the heterologous region encodes a mammalian gene, the DNA flanking the gene usually does not flank the mammalian genomic DNA in the genome of the source organism. Another example of a heterologous region is a construct where the coding sequence itself is not found in nature (e.g., a cDNA where the genomic coding sequence contains introns or synthetic sequences having codons different than the native gene). Allelic variations or naturally-occurring mutational events do not give rise to a heterologous region of DNA as defined herein.

A "coding sequence" is an in-frame sequence of codons that correspond to or encode a protein or peptide sequence. Two coding sequences correspond to each other if the sequences or their complementary sequences encode the same amino acid sequences. A coding sequence in association with appropriate regulatory sequences may be transcribed and translated into a polypeptide. A polyadenylation signal and transcription termination sequence will usually be located 3' to the coding sequence. A "promoter sequence" is a DNA regulatory region capable of initiating transcription of a downstream (3' direction) coding sequence, and typically contain additional sites for binding of regulatory molecules, e.g., transcription factors, that affect the transcription of the coding sequence. A coding sequence is "under the control" of the promoter sequence or "operatively linked" to the promoter when RNA polymerase binds the promoter sequence in a cell and transcribes the coding sequence into mRNA, which is then in turn translated into the protein encoded by the coding sequence.

The general structure of antibodies in vertebrates now is well understood. See Edelman, G. M., *Ann. N.Y. Acad. Sci.*, 190:5 (1971). Antibodies consist of two identical light polypeptide chains of molecular weight approximately 23,000 daltons (the "light chain"), and two identical heavy chains of molecular weight 53,000-70,000 (the "heavy chain"). The four chains are joined by disulfide bonds in a "Y" configuration wherein the light chains bracket the heavy chains starting at the mouth of the "Y" configuration. The "branch" portion of the "Y" configuration is designated the $F_{ab}$ region; the stem portion of the "Y" configuration is designated the Fc region. The amino acid sequence orientation runs from the N-terminal end at the top of the "Y" configuration to the C-terminal end at the bottom of each chain. The N-terminal end possesses the variable region having specificity for the antigen that elicited it, and is approximately 100 amino acids in length, there being slight variations between light and heavy chain and from antibody to antibody.

The variable region is linked in each chain to a constant region that extends the remaining length of the chain and that within a particular class of antibody does not vary with the specificity of the antibody (i.e., the antigen eliciting it). There are five known major classes of constant regions that determine the class of the immunoglobulin molecule (IgG, IgM, IgA, IgD, and IgE corresponding to γ, μ, α, δ, and ε (gamma, mu, alpha, delta, or epsilon) heavy chain constant regions). The constant region or class determines subsequent effector function of the antibody, including activation of complement (see Kabat, E. A., *Structural Concepts in Immunology and Immunochemistry*, 2nd Ed., p. 413-436, New York, N.Y.: Holt, Rinehart, Winston (1976)), and other cellular responses (see Andrews et al., *Clinical Immunology*, pp. 1-18, W. B. Sanders, Philadelphia, Pa. (1980); Kohl et al., *Immunology*, 48:187 (1983)); while the variable region determines the antigen with which it will react. Light chains are classified as either κ (kappa) or λ (lambda). Each heavy chain class can be prepared with either kappa or lambda light chain. The light and heavy chains are covalently bonded to each other, and the "tail" portions of the two heavy chains are bonded to each other by covalent disulfide linkages when the immunoglobulins are generated either by hybridomas or by B-cells.

The expression "variable region" or "VR" refers to the domains within each pair of light and heavy chains in an antibody that are involved directly in binding the antibody to the antigen. Each heavy chain has at one end a variable region (VH) followed by a number of constant domains Each light chain has a variable region (VL) at one end and a constant domain at its other end; the constant domain of the light chain is aligned with the first constant domain of the heavy chain, and the light chain variable domain is aligned with the variable domain of the heavy chain.

The expressions "complementarity-determining region," "hypervariable region," or "CDR" refer to one or more of the hyper-variable or complementarity-determining regions ("CDRs") found in the variable regions of light or heavy chains of an antibody (See Kabat et al., *Sequences of Proteins of Immunological Interest*, 4$^{th}$ ed., Bethesda, Md.: U.S. Dept. of Health and Human Services, Public Health Service, National Institutes of Health (1987)). These expressions include the hypervariable regions as defined by Kabat et al., (*Sequences of Proteins of Immunological Interest*, NIH Publication No. 91-3242, Bethesda, Md.: U.S. Dept. of Health and Human Services, National Institutes of Health (1983)) or the hypervariable loops in 3-dimensional structures of antibodies (Chothia and Lesk, *J. Mol. Biol.*, 196: 901-917 (1987)). The CDRs in each chain are held in close proximity by framework regions ("FRs") and, with the CDRs from the other chain, contribute to the formation of the antigen binding site. Within the CDRs there are select amino acids that have been described as the selectivity determining regions ("SDRs") that represent the critical contact residues used by the CDR in the antibody-antigen interaction (see Kashmiri et al., *Methods*, 36(1):25-34 (2005)).

An "epitope" or "binding site" is an area or region on an antigen to which an antigen-binding peptide (such as an antibody) specifically binds. A protein epitope may comprise amino acid residues directly involved in the binding (also called immunodominant component of the epitope) and other amino acid residues, which are not directly involved in the binding, such as amino acid residues that are effectively blocked by the specifically antigen binding peptide (in other words, the amino acid residue is within the "footprint" of the specifically antigen binding peptide). The term epitope herein includes both types of amino acid binding sites in any particular region of CoV-S, e.g., SARS-CoV-S or SARS-CoV-2-S, that specifically binds to an anti-CoV-S antibody. CoV-S may comprise a number of different epitopes, which may include, without limitation, (1) linear peptide antigenic determinants, (2) conformational antigenic determinants that consist of one or more non-contiguous amino acids located near each other in a mature CoV-S conformation; and (3) post-translational antigenic determinants that consist, either in whole or part, of molecular structures covalently attached to a CoV-S protein such as carbohydrate groups. In particular, the term "epitope" includes the specific residues in a protein or peptide, e.g., CoV-S, which are involved in the binding of an antibody to such protein or peptide as determined by known and accepted methods such as alanine scanning techniques or the use of various S protein portions with varying lengths.

The phrase that an antibody (e.g., first antibody) binds "substantially" or "at least partially" the same epitope as another antibody (e.g., second antibody) means that the epitope binding site for the first antibody comprises at least 10%, 20%, 30%, 40%, 50%, 60%, 70%, 80%, 90%, or more of the amino acid residues on the antigen that constitutes the epitope binding site of the second antibody. Also, that a first antibody binds substantially or partially the same or overlapping epitope as a second antibody means that the first and second antibodies compete in binding to the antigen, as described above. Thus, the term "binds to substantially the same epitope or determinant as" a monoclonal antibody means that an antibody "competes" with the antibody.

The phrase "binds to the same or overlapping epitope or determinant as" an antibody of interest means that an antibody "competes" with said antibody of interest for at least one, (e.g., at least 2, at least 3, at least 4, at least 5) or all residues on CoV-S to which said antibody of interest specifically binds. The identification of one or more antibodies that bind(s) to substantially or essentially the same epitope as the monoclonal antibodies described herein can be readily determined using alanine scanning Additionally, any one of variety of immunological screening assays in which antibody competition can be assessed. A number of such assays are routinely practiced and well known in the art (see, e.g., U.S. Pat. No. 5,660,827, issued Aug. 26, 1997, which is specifically incorporated herein by reference). It will be understood that actually determining the epitope to which an antibody described herein binds is not in any way required to identify an antibody that binds to the same or substantially the same or overlapping epitope as the monoclonal antibody described herein.

For example, where the test antibodies to be examined are obtained from different source animals, or are even of a different Ig isotype, a simple competition assay may be employed in which the control antibody is mixed with the test antibody and then applied to a sample containing CoV-S. Protocols based upon ELISAs, radioimmunoassays, Western blotting, and the use of BIACORE® (GE Healthcare Life Sciences, Marlborough, Mass.) analysis are suitable for use in such simple competition studies.

In certain embodiments, the control anti-CoV-S antibody is pre-mixed with varying amounts of the test antibody (e.g., in ratios of about 1:1, 1:2, 1:10, or about 1:100) for a period of time prior to applying to the CoV-S (e.g., SARS-CoV-S or SARS-CoV-2-S) antigen sample. In other embodiments, the control and varying amounts of test antibody can simply be added separately and admixed during exposure to the SARS-CoV-S or SARS-CoV-2-S antigen sample. As long as bound antibodies can be distinguished from free antibodies (e.g., by using separation or washing techniques to eliminate unbound antibodies) and control antibody from the test antibody (e.g., by using species specific or isotype specific secondary antibodies or by specifically labeling the control antibody with a detectable label) it can be determined if the test antibody reduces the binding of the control antibody to the SARS-CoV-S or SARS-CoV-2-S antigens, indicating that the test antibody recognizes substantially the same epitope as the control anti-CoV-S antibody. The binding of the (labeled) control antibody in the presence of a completely irrelevant antibody (that does not bind CoV-S) can serve as the control high value. The control low value can be obtained by incubating the labeled control antibody with the same but unlabeled control antibody, where competition would occur and reduce binding of the labeled antibody. In a test assay, a significant reduction in labeled antibody reactivity in the presence of a test antibody is indicative of a test antibody that recognizes substantially the same epitope, i.e., one that competes with the labeled control antibody. For example, any test antibody that reduces the binding of the control antibody to SARS-CoV-S or SARS-CoV-2-S by at least about 50%, such as at least about 60%, or more preferably at least about 70% (e.g., about 65-100%), at any ratio of test antibody between about 1:1 or 1:10 and about 1:100 is considered to be an antibody that binds to substantially the same or overlapping epitope or determinant as the control antibody.

Preferably, such test antibody will reduce the binding of the control antibody to SARS-CoV-S or SARS-CoV-2-S (or another CoV-S) antigen preferably at least about 50%, at least about 60%, at least about 80%, or at least about 90% (e.g., about 95%) of the binding of the control antibody observed in the absence of the test antibody.

A simple competition assay in which a test antibody is applied at saturating concentration to a surface onto which SARS-CoV-S or SARS-CoV-2-S (or another CoV-S) is immobilized also may be advantageously employed. The surface in the simple competition assay is preferably a BIACORE® (GE Healthcare Life Sciences, Marlborough, Mass.) chip (or other media suitable for surface plasmon resonance ("SPR") analysis). The binding of a control antibody that binds SARS-CoV-S or SARS-CoV-2-S to the COV-S-coated surface is measured. This binding to the SARS-CoV-S- or SARS-CoV-2-S-containing surface of the control antibody alone is compared with the binding of the control antibody in the presence of a test antibody. A significant reduction in binding to the SARS-CoV-S- or SARS-CoV-2-S-containing surface by the control antibody in the presence of a test antibody indicates that the test antibody recognizes substantially the same epitope as the control antibody such that the test antibody "competes" with the control antibody. Any test antibody that reduces the binding of control antibody by at least about 20% or more, at least about 40%, at least about 50%, at least about 70%, or more, can be considered to be an antibody that binds to substantially the same epitope or determinant as the control antibody. Preferably, such test antibody will reduce the binding of the control antibody to SARS-CoV-S or SARS-CoV-2-S by at least about 50% (e.g., at least about 60%, at least about 70%, or more). It will be appreciated that the order of control and test antibodies can be reversed; i.e. the control antibody can be first bound to the surface and then the test antibody is brought into contact with the surface thereafter in a competition assay. Preferably, the "sandwich-style" binding assay infra is used. Alternatively, the antibody having greater affinity for SARS-CoV-S or SARS-CoV-2-S antigen is bound to the SARS-CoV-S- or SARS-CoV-2-S-containing surface first, as it will be expected that the decrease in binding seen for the second antibody (assuming the antibodies are competing) will be of greater magnitude. Further examples of such assays are provided in e.g., Saunal and Regenmortel, *J. Immunol. Methods,* 183:33-41 (1995), the disclosure of which is incorporated herein by reference.

In addition, whether an antibody binds the same or overlapping epitope(s) on COV-S as another antibody or the epitope bound by a test antibody may in particular be determined using a Western-blot based assay. In this assay a library of peptides corresponding to the antigen bound by the antibody, the CoV-S protein, is made, that comprise overlapping portions of the protein, typically 10 25, 10-20, or 10-15 amino acids long. These different overlapping amino acid peptides encompassing the CoV-S sequence are synthesized and covalently bound to a PEPSPOTS™ nitrocellulose membrane (JPT Peptide Technologies, Berlin, Germany). Blots are then prepared and probed according to the manufacturer's recommendations.

Essentially, the immunoblot assay then detects by fluorometric means what peptides in the library bind to the test antibody and thereby can identify what residues on the antigen, i.e., COV-S, interact with the test antibody. (See U.S. Pat. No. 7,935,340, incorporated by reference herein).

Various epitope mapping techniques are known in the art. By way of example, X-ray co-crystallography of the antigen and antibody; NMR; SPR (e.g., at 25° or 37° C.); array-based oligo-peptide scanning (or "pepscan analysis"); site-directed mutagenesis (e.g., alanine scanning); mutagenesis mapping; hydrogen-deuterium exchange; phage display; and limited proteolysis are all epitope mapping techniques that are well known in the art (See, e.g., Epitope Mapping Protocols: Second Edition, Methods in Molecular Biology, editors Mike Schutkowski and Ulrich Reineke, $2^{nd}$ Ed., New York, N.Y.: Humana Press (2009), and *Epitope Mapping Protocols, Methods in Molecular Biology*, editor Glenn Morris, $1^{st}$ Ed., New York, N.Y.: Humana Press (1996), both of which are herein incorporated by referenced in their entirety).

The identification of one or more antibodies that bind(s) to substantially or essentially the same epitope as the monoclonal antibodies described herein, e.g., any one of antibodies as described herein and in FIGS. 1, 2 and 36, can be readily determined using any one of variety of immunological screening assays in which antibody competition can be assessed. A number of such assays are routinely practiced and well known in the art (see, e.g., U.S. Pat. No. 5,660,827, issued Aug. 26, 1997, which is incorporated herein by reference). It will be understood that determining the epitope to which an antibody described herein binds is not in any way required to identify an antibody that binds to the same or substantially the same epitope as the monoclonal antibody described herein.

For example, where the test antibodies to be examined are obtained from different source animals, or are even of a different Ig isotype, a simple competition assay may be employed in which the control antibody (one of antibodies as described above and in FIGS. 1, 2 and 36, for example) is mixed with the test antibody and then applied to a sample containing either or both SARS-CoV-S or SARS-CoV-2-S, each of which is known to be bound by antibodies as described above and in FIGS. 1, 2 and 36. Protocols based upon ELISAs, radioimmunoassays, Western blotting, and BIACORE® (GE Healthcare Life Sciences, Marlborough, Mass.) analysis (as described in the Examples section herein) are suitable for use in such simple competition studies.

In certain embodiments, the method comprises pre-mixing the control antibody with varying amounts of the test antibody (e.g., in ratios of about 1:1, 1:2, 1:10, or about 1:100) for a period of time prior to applying to the CoV-S antigen sample. In other embodiments, the control and varying amounts of test antibody can be added separately and admixed during exposure to the CoV-S antigen sample. As long as bound antibodies can be distinguished from free antibodies (e.g., by using separation or washing techniques to eliminate unbound antibodies) and control antibody from the test antibody (e.g., by using species specific or isotype specific secondary antibodies or by specifically labelling the control antibody with a detectable label), the method can be used to determine that the test antibody reduces the binding of the control antibody to the COV-S antigen, indicating that the test antibody recognizes substantially the same epitope as the control antibody (e.g., antibodies as described herein and in FIGS. 1, 2 and 36). The binding of the (labeled) control antibody in the presence of a completely irrelevant antibody (that does not bind CoV-S) can serve as the control high value. The control low value can be obtained by incubating the labeled control antibody with the same but unlabeled control antibody, where competition would occur and reduce binding of the labeled antibody. In a test assay, a significant reduction in labeled antibody reactivity in the presence of a test antibody is indicative of a test antibody that recognizes substantially the same epitope, i.e., one that competes with the labeled control antibody. For example, any test antibody that reduces the binding of any one of antibodies described herein and in FIGS. 1, 2 and 36, to both of SARS-CoV-S or SARS-CoV-2-S antigens by at least about 50%, such as at least about 60%, or more preferably at least about 70% (e.g., about 65-100%), at any ratio of control antibody as described herein and in FIGS. 1, 2 and 36, test antibody between about 1:1 or 1:10 and about 1:100 is considered to be an antibody that binds to substantially the same epitope or determinant as any one of antibodies described herein and in FIGS. 1, 2 and 36, respectively. Preferably, such test antibody will reduce the binding of any one of antibodies as described herein and in FIGS. 1, 2 and 36, to at least one, preferably each, of the SARS-CoV-S or SARS-CoV-2-S antigens preferably at least about 50%, at least about 60%, at least about 80% or at least about 90% (e.g., about 95%) of the binding of any one of antibodies described herein and in FIGS. 1, 2 and 36, observed in the absence of the test antibody. These methods can be adapted to identify and/or evaluate antibodies that compete with other control antibodies.

A simple competition assay in which a test antibody is applied at saturating concentration to a surface onto which either SARS-CoV-S or SARS-CoV-2-S, or both, are immobilized also may be advantageously employed. The surface in the simple competition assay is preferably of a media suitable for OCTET® and/or PROTEON®. The binding of a control antibody (e.g., any one of antibodies described herein and in FIGS. 1, 2 and 36) to the CoV-S-coated surface is measured. This binding to the CoV-S-containing surface of the control antibody alone is compared with the binding of the control antibody in the presence of a test antibody. A significant reduction in binding to the CoV-S-containing surface by the control antibody in the presence of a test antibody indicates that the test antibody recognizes substantially the same epitope as the control antibody such that the test antibody "competes" with the control antibody. Any test antibody that reduces the binding of control antibody (such as anyone of antibodies described herein and in FIGS. 1, 2 and 36) to both of SARS-CoV-S and SARS-CoV-2-S antigens by at least about 20% or more, at least about 40%, at least about 50%, at least about 70%, or more, can be considered to be an antibody that binds to substantially the same epitope or determinant as the control antibody (e.g., any one of antibodies described herein and in FIGS. 1, 2 and 36). Preferably, such test antibody will reduce the binding of the control antibody (e.g., any one of antibodies described herein and in FIGS. 1, 2 and 36) to the CoV-S antigen by at least about 50% (e.g., at least about 60%, at least about 70%, or more). It will be appreciated that the order of control and test antibodies can be reversed; i.e. the control antibody can be first bound to the surface and then the test antibody is brought into contact with the surface thereafter in a competition assay. Preferably, the antibody having higher affinity for SARS-CoV-S and SARS-CoV-2-S is bound to the CoV-S-containing surface first, as it will be expected that the decrease in binding seen for the second antibody (assuming the antibodies are competing) will be of greater magnitude. Further examples of such assays are provided in, e.g., Saunal and Regenmortel, *J. Immunol. Methods,* 183:33 41 (1989), the disclosure of which is incorporated herein by reference.

Determination of whether an antibody, antigen-binding fragment thereof, or antibody derivative, e.g., an affinity-matured antibody or antigen binding fragment of any of the anti-CoV-S antibodies exemplified herein, binds within one of the epitope regions defined above can be carried out in ways known to the person skilled in the art. In another example of such mapping/characterization methods, an epitope region for an anti-CoV-S antibody may be determined by epitope "footprinting" using chemical modification of the exposed amines/carboxyls in the SARS-CoV-S and SARS-CoV-2-S protein. One specific example of such a foot-printing technique is the use of hydrogen-deuterium exchange detected by mass spectrometry ("HXMS"), wherein a hydrogen/deuterium exchange of receptor and ligand protein amide protons, binding, and back exchange occurs, wherein the backbone amide groups participating in protein binding are protected from back exchange and therefore will remain deuterated. Relevant regions can be identified at this point by peptic proteolysis, fast microbore high-performance liquid chromatography separation, and/or electrospray ionization mass spectrometry (See, e.g., Ehring H., *Analytical Biochemistry*, 267(2):252-259 (1999) and Engen, J. R. & Smith, D. L., *Anal. Chem.*, 73:256A-265A (2001)). Another example of a suitable epitope identification technique is nuclear magnetic resonance epitope mapping ("NMR"), where typically the position of the signals in two-dimensional NMR spectras of the free antigen and the antigen complexed with the antigen binding peptide, such as an antibody, are compared. The antigen typically is selectively isotopically labeled with $^{15}$N so that only signals corresponding to the antigen and no signals from the antigen binding peptide are seen in the NMR-spectrum. Antigen signals originating from amino acids involved in the interaction with the antigen binding peptide typically will shift position in the spectras of the complex compared to the spectras of the free antigen, and the amino acids involved in the binding can be identified that way. See, e.g., *Ernst Schering Res. Found. Workshop*, (44):149-67 (2004); Huang et al., *J. Mol. Biol.*, 281(1):61-67 (1998); and Saito and Patterson, *Methods*, 9(3):516-24 (1996). Epitope mapping/characterization also can be performed using mass spectrometry ("MS") methods (See, e.g., Downard, *J. Mass Spectrom.*, 35(4):493-503 (2000) and Kiselar and Downard, *Anal. Chem.*, 71(9):1792-801 (1999)).

Protease digestion techniques also can be useful in the context of epitope mapping and identification. Antigenic determinant-relevant regions/sequences can be determined by protease digestion, e.g. by using trypsin in a ratio of about 1:50 to SARS-CoV-S or SARS-CoV-2-S overnight ("o/n") digestion at 37° C. and pH 7-8, followed by mass spectrometry ("MS") analysis for peptide identification. The peptides protected from trypsin cleavage by the anti-CoV-S antibody can subsequently be identified by comparison of samples subjected to trypsin digestion and samples incubated with antibody and then subjected to digestion by e.g. trypsin (thereby revealing a footprint for the antibody). Other enzymes like chymotrypsin or pepsin can be used in similar epitope characterization methods. Moreover, enzymatic digestion can provide a quick method for analyzing whether a potential antigenic determinant sequence is within a region of CoV-S in the context of a CoV-S-binding polypeptide. If the polypeptide is not surface exposed, it is most likely not relevant in terms of immunogenicity/antigenicity (See, e.g., Manca, *Ann. Ist. Super. Santà.*, 27(1):15-9 (1991) for a discussion of similar techniques).

Site-directed mutagenesis is another technique useful for characterization of a binding epitope. For example, in "alanine-scanning" site-directed mutagenesis (also known as alanine scanning, alanine scanning mutagenesis, alanine scanning mutations, combinatorial alanine scanning, or creation of alanine point mutations, for example), each residue within a protein segment is replaced with an alanine residue (or another residue such as valine where alanine is present in the wild-type sequence) through such methodologies as direct peptide or protein synthesis, site-directed mutagenesis, the GENEART™ Mutagenesis Service (Thermo Fisher Scientific, Waltham, Mass. U.S.A.) or shotgun mutagenesis, for example. A series of single point mutants of the molecule is thereby generated using this technique; the number of mutants generated is equivalent to the number of residues in the molecule, each residue being replaced, one at a time, by a single alanine residue. Alanine is generally used to replace native (wild-type) residues because of its non-bulky, chemically inert, methyl functional group that can mimic the secondary structure preferences that many other amino acids may possess. Subsequently, the effects replacing a native residue with an alanine has on binding affinity of an alanine scanning mutant and its binding partner can be measured using such methods as, but not limited to, SPR binding experiments. If a mutation leads to a significant reduction in binding affinity, it is most likely that the mutated residue is involved in binding. Monoclonal antibodies specific for structural epitopes (i.e., antibodies that do not bind the unfolded protein) can be used as a positive control for binding affinity experiments to verify that the alanine-replacement does not influence the overall tertiary structure of the protein (as changes to the overall fold of the protein may indirectly affect binding and thereby produce a false positive result). See, e.g., Clackson and Wells, *Science*, 267:383-386 (1995); Weiss et al., *Proc. Natl. Acad. Sci. USA*, 97(16):8950-8954 (2000); and Wells, *Proc. Natl. Acad. Sci. USA*, 93:1-6 (1996). Example 5 identifies the specific epitope or residues of CoV-S which specifically interact with the anti-CoV-S antibodies disclosed herein.

Electron microscopy can also be used for epitope "footprinting". For example, Wang et al., *Nature*, 355:275-278 (1992) used coordinated application of cryoelectron microscopy, three-dimensional image reconstruction, and X-ray crystallography to determine the physical footprint of a Fab-fragment on the capsid surface of native cowpea mosaic virus.

Other forms of "label-free" assay for epitope evaluation include SPR (sold commercially as the BIACORE® system, GE Healthcare Life Sciences, Marlborough, Mass.) and reflectometric interference spectroscopy ("RifS") (See, e.g., Fagerstam et al., *Journal of Molecular Recognition*, 3:208-14 (1990); Nice et al., *J. Chromatogr.*, 646:159-168 (1993); Leipert et al., *Angew. Chem. Int.* Ed., 37:3308-3311 (1998); Kroger et al., *Biosensors and Bioelectronics*, 17:937-944 (2002)).

The expressions "framework region" or "FR" refer to one or more of the framework regions within the variable regions of the light and heavy chains of an antibody (See Kabat et al., *Sequences of Proteins of Immunological Interest*, 4$^{th}$ edition, Bethesda, Md.: U.S. Dept. of Health and Human Services, Public Health Service, National Institutes of Health (1987)). These expressions include those amino acid sequence regions interposed between the CDRs within the variable regions of the light and heavy chains of an antibody.

The term "Fc region" is used to define a C-terminal region of an immunoglobulin heavy chain. The "Fc region" may be a native sequence Fc region or a variant Fc region. Although the boundaries of the Fc region of an immunoglobulin heavy chain might vary, the human IgG heavy chain Fc region is usually defined to stretch from an amino acid residue at position Cys226, or from Pro230, to the carboxyl-terminus thereof. The numbering of the residues in the Fc region is that of the EU index as in Kabat. Kabat et al., *Sequences of Proteins of Immunological Interest*, 5th edition, Bethesda, Md.: U.S. Dept. of Health and Human Services, Public Health Service, National Institutes of Health (1991). The Fc region of an immunoglobulin generally comprises two constant domains, CH2 and CH3.

The terms "Fc receptor" and "FcR" describe a receptor that binds to the Fc region of an antibody. The preferred FcR is a native sequence human FcR. Moreover, a preferred FcR is one that binds an IgG antibody (a gamma receptor) and includes receptors of the FcγRI, FcγRII, and FcγRIII subclasses, including allelic variants and alternatively spliced forms of these receptors. FcγRII receptors include FcγRIIA (an "activating receptor") and FcγRIIB (an "inhibiting receptor"), which have similar amino acid sequences that differ primarily in the cytoplasmic domains thereof. FcRs are reviewed in Ravetch and Kinet, *Ann. Rev. Immunol.*, 9:457-92 (1991); Capel et al., *Immunomethods*, 4:25-34 (1994); and de Haas et al., *J. Lab. Clin. Med.*, 126:330-41 (1995). "FcR" also includes the neonatal receptor, FcRn, which is responsible for the transfer of maternal IgGs to the fetus (Guyer et al., *J. Immunol.*, 117:587 (1976); and Kim et al., *J. Immunol.*, 24:249 (1994)), and which primarily functions to modulate and/or extend the half-life of antibodies in circulation. To the extent that the disclosed anti-CoV-S antibodies are aglycosylated, as a result of the expression system and/or sequence, the subject antibodies are expected to bind FcRn receptors, but not to bind (or to minimally bind) Fcγ receptors.

A "functional Fc region" possesses at least one effector function of a native sequence Fc region. Exemplary "effector functions" include C1q binding; complement dependent cytotoxicity ("CDC"); Fc receptor binding; antibody-dependent cell-mediated cytotoxicity ("ADCC"); phagocytosis; down-regulation of cell surface receptors (e.g. B cell receptor ("BCR")), etc. Such effector functions generally require the Fc region to be combined with a binding domain (e.g. an antibody variable domain) and can be assessed using various assays known in the art for evaluating such antibody effector functions.

A "native sequence Fc region" comprises an amino acid sequence identical to the amino acid sequence of an Fc region found in nature. A "variant Fc region" comprises an amino acid sequence that differs from that of a native sequence Fc region by virtue of at least one amino acid modification, yet retains at least one effector function of the native sequence Fc region. Preferably, the variant Fc region has at least one amino acid substitution compared to a native sequence Fc region or to the Fc region of a parent polypeptide, e.g. from about one to about ten amino acid substitutions, and preferably from about one to about five amino acid substitutions in a native sequence Fc region or in the Fc region of the parent polypeptide. The variant Fc region herein will preferably possess at least about 80% sequence identity with a native sequence Fc region and/or with an Fc region of a parent polypeptide, and most preferably at least about 90% sequence identity therewith, more preferably at least about 95%, at least about 96%, at least about 97%, at least about 98%, or at least about 99% sequence identity therewith.

In some embodiments, the Fc region of an antibody or antigen-binding antibody fragment of the present disclosure may bind to an Fc receptor (FcR). The FcR may be, but is not limited to, Fc gamma receptor (FcgR), FcgRI, FcgRIIA, FcgRIIB1, FcgRIIB2, FcgRIIIA, FcgRIIIB, Fc epsilon receptor (FceR), FceRI, FceRII, Fc alpha receptor (FcaR), FcaRI, Fc alpha/mu receptor (Fca/mR), or neonatal Fc receptor (FcRn). The Fc may be an IgM, IgD, IgG, IgE, or IgA isotype. An IgG isotype may be an IgG1, IgG2, IgG3, or IgG4.

Certain amino acid modifications in the Fc region are known to modulate Ab effector functions and properties, such as, but not limited to, antibody-dependent cellular cytotoxicity (ADCC), antibody-dependent cellular phagocytosis (ADCP), complement dependent cytotoxicity (CDC), and half-life (Wang X. et al., Protein Cell. 2018 January; 9(1): 63-73; Dall'Acqua W. F. et al., *J Biol Chem.* Aug. 18, 2006; 281(33):23514-24. Epub Jun. 21, 2006; Monnet C. et al, Front Immunol. Feb. 4, 2015; 6:39. doi: 10.3389/fimmu.2015.00039. eCollection 2015). The mutation may be symmetrical or asymmetrical. In certain cases, antibodies with Fc regions that have asymmetrical mutation(s) (i.e., two Fc regions are not identical) may provide better functions such as ADCC (Liu Z. et al. J Biol Chem. Feb. 7, 2014; 289(6): 3571-3590).

Any of the antibody variable region sequences disclosed herein may be used in combination with a wild-type (WT) Fc or a variant Fc. In particular embodiments, an Fc selected from the Fc sequences described in Table 1 may be used. Any of the variable region sequences disclosed herein may be used in combination with any appropriate Fc including any of the Fc variants provided in Table 1 to form an antibody or an antigen-binding antibody fragment of the present disclosure. The lysine (K) at the C-terminus of each Fc may be present or absent.

TABLE 1

Exemplary Fc Variants.

| Fc Variant Name | SEQ ID NO: | Differences from WT |
|---|---|---|
| WT | 11 | 0 |
| YTE | 12 | 3 |
| LA | 13 | 2 |
| LS | 14 | 2 |
| LA-RE | 15 | 4 |
| DEL | 16 | 2 |
| LALA-DEL | 17 | 4 |

An IgG1-type Fc optionally may comprise one or more amino acid substitutions. Such substitutions may include, for example, N297A, N297Q, D265A, L234A, L235A, C226S, C229S, P238S, E233P, L234V, G236-deleted, P238A, A327Q, A327G, P329A, K322A, L234F, L235E, P331S, T394D, A330L, P331S, F243L, R292P, Y300L, V3051, P396L, S239D, I332E, S298A, E333A, K334A, L234Y, L235Q, G236W, S239M, H268D, D270E, K326D, A330M, K334E, G236A, K326W, S239D, E333S, S267E, H268F, S324T, E345R, E430G, S440Y, M428L, N434S, L328F, M252Y, S254T, T256E, and/or any combination thereof (the residue numbering is according to the EU index as in Kabat) (Dall'Acqua W. F. et al., J Biol Chem. Aug. 18, 2006; 281(33):23514-24. Epub Jun. 21, 2006; Wang X. et al., Protein Cell. 2018 January; 9(1): 63-73), or for example, N434A, Q438R, S440E, L432D, N434L, and/or any combination thereof (the residue numbering according to EU numbering). The Fc region may further comprise one or more additional amino acid substitutions. Such substitutions may include but are not limited to A330L, L234F, L235E, P3318, and/or any combination thereof (the residue numbering is according to the EU index as in Kabat). Specific exemplary substitution combinations for an IgG1-type Fc include, but not limited to: M252Y, S254T, and T256E ("YTE" variant); M428L and N434A ("LA" variant), M428L and N434S ("LS" variant); M428L, N434A, Q438R, and S440E ("LA-RE" variant); L432D and N434L ("DEL" variant); and L234A, L235A, L432D, and N434L ("LALA-DEL" variant) (the residue numbering is according to the EU index as in Kabat). In particular embodiments, an IgG1-type Fc variant may comprise the amino acid sequence of SEQ ID NOS: 11, 12, 13, 14, 15, 16, or 17. In one embodiment, the Fc variant is an LA variant and comprises the amino acid sequence of SEQ ID NO: 13.

When the Ab is an IgG2, the Fc region optionally may comprise one or more amino acid substitutions. Such substitutions may include but are not limited to P238S, V234A, G237A, H268A, H268Q, H268E, V309L, N297A, N297Q, A330S, P331S, C232S, C233S, M252Y, S254T, T256E, and/or any combination thereof (the residue numbering is according to the EU index as in Kabat). The Fc region optionally may further comprise one or more additional amino acid substitutions. Such substitutions may include but are not limited to M252Y, S254T, T256E, and/or any combination thereof (the residue numbering is according to the EU index as in Kabat).

An IgG3-type Fc region optionally may comprise one or more amino acid substitutions. Such substitutions may include but are not limited to E235Y (the residue numbering is according to the EU index as in Kabat).

An IgG4-type Fc region optionally may comprise one or more amino acid substitutions. Such substitutions may include but are not limited to, E233P, F234V, L235A, G237A, E318A, S228P, L236E, S241P, L248E, T394D, M252Y, S254T, T256E, N297A, N297Q, and/or any combination thereof (the residue numbering is according to the EU index as in Kabat). The substitution may be, for example, S228P (the residue numbering is according to the EU index as in Kabat).

In some cases, the glycan of the human-like Fc region may be engineered to modify the effector function (for example, see Li T. et al., *Proc Natl Acad Sci USA*. Mar. 28, 2017; 114(13):3485 3490. doi: 10.1073/pnas.1702173114. Epub Mar. 13, 2017).

An "isolated" antibody, as used herein, refers to an antibody that is substantially free of other antibodies having different antigenic specificities. In some embodiments, an isolated antibody is substantially free of other unintended cellular material and/or chemicals.

As used herein, "specific binding" or "specifically binds" means that the interaction of the antibody, or antigen-binding portion thereof, with an antigen is dependent upon the presence of a particular structure (e.g., antigenic determinant or epitope). For example, the antibody, or antigen-binding portion thereof, binds to a specific protein, rather than proteins generally. In some embodiments, an antibody, or antigen-binding portion thereof, specifically binds a target, e.g., SARS-CoV-S and/or SARS-CoV-S-2. In some embodiments, an antibody, or antigen-binding portion thereof, specifically binds to more than one coronavirus spike protein, e.g., the spike protein of SARS-CoV-S and the spike protein of SARS-CoV-2-S, for example. In some embodiments, the antibody, or antigen-binding portion thereof, specifically binds to two different, but related, antigens, e.g., the spike protein of SARS-CoV1-S and the spike protein of SARS-CoV2-S, e.g., via a conserved epitope.

B. Anti-CoV-S Antibodies and Binding Fragments Thereof Having Binding Activity for CoV-S CoV-S refers to the S protein of a coronavirus which is expressed on the surface of virions as a structural protein. As mentioned previously, the S protein plays an essential role for coronaviruses in binding to receptors on the host cell and determines host tropism (Zhu Z. et al., *Infect Genet Evol*. 2018 July; 61:183-184). SARS-CoV and SARS-CoV-2 bind to angiotensin-converting enzyme 2 (ACE2) of the host cell via the S protein's receptor-binding domains (RBDs) and uses ACE2 as a receptor to enter the host cells (Ge X. Y. et al., *Nature*. Nov. 28, 2013; 503(7477):535-8. doi: 10.1038/nature12711. Epub Oct. 30, 2013; Hoffmann M. et al., *Cell*. Mar. 4, 2020. pii: S0092 8674(20)30229-4). SARS-CoV can also use CD209L (also known as L-SIGN) as an alternative receptor (Jeffers S. A. et al., *Proc Natl Acad Sci USA*. Nov. 2, 2004; 101(44):15748-53. Epub Oct. 20, 2004). MERS-CoV binds dipeptidyl peptidase 4 ("DPP4", also known as CD26) of the host cells via a different RBD of the S protein. Cell entry of coronaviruses depends on not only binding of the S protein to a host cell receptor but often also priming of the S protein by host cell proteases, and recently SARS-CoV-2 was found to use the serine protease TMPRSS2 for S protein priming and then ACE2 for entry (Wu A. et al., *Cell Host Microbe*. Mar. 11, 2020; 27(3):325-328; Hoffmann M. et al., *Cell*. Mar. 4, 2020. pii: 50092-8674(20) 30229-4).

The S protein of SARS-CoV is referred to as SARS-CoV-S and may for example comprise the amino acid sequence of SEQ ID NO: 1 (1288 amino acids). The S protein of SARS-CoV-2 is referred to as SARS-CoV-2-S and may for example comprise the amino acid sequence of SEQ ID NO: 5 (1273 amino acids).

The present disclosure provides exemplary antibodies and antigen-binding antibody fragments that specifically bind to CoV, wherein at least some of these antibodies and antigen-binding antibody fragments specifically bind to SARS-CoV-2-S and/or SARS-CoV-2-S. Due to the sequence similarity among different CoV species, such antibodies or antigen-binding antibody fragments of the present disclosure may also cross react with the S protein of other CoV species.

The exemplary S proteins of CoV that the antibodies or antigen-binding antibody fragments of the present disclosure may specifically bind include by way of example, Bat SARS CoV (GenBank Accession No. FJ211859), SARS CoV (GenBank Accession No. FJ211860), BtSAR-S.HKU3.1 (GenBank Accession No. DQ022305), BtSAR-S.HKU3.2 (GenBank Accession No. DQ084199), BtSAR-S.HKU3.3 (GenBank Accession No. DQ084200), BtSARS.Rm1 (GenBank Accession No. DQ412043), BtCoV.279.2005 (GenBank Accession No. DQ648857), BtSARS.Rf1 (GenBank Accession No. DQ412042), BtCoV.273.2005 (GenBank Accession No. DQ648856), BtSARS.Rp3 (GenBank Accession No. DQ071615), SARS CoV.A022 (GenBank Accession No. AY686863), SARS-CoV.CUHK-W1 (GenBank Accession No. AY278554), SARSCoV.GDO1 (GenBank Accession No. AY278489), SARSCoV.HC.SZ.61.03 (GenBank Accession No. AY515512), SARSCoV.SZ16 (GenBank Accession No. AY304488), SARSCoV.Urbani (GenBank Accession No. AY278741), SARSCoV.civet010 (GenBank Accession No. AY572035), or SARSCoV.MA.15 (GenBank Accession No. DQ497008), Rs SHC014 (GenBank® Accession No. KC881005), Rs3367 (GenBank® Accession No. KC881006), WiV1 S (GenBank® Accession No. KC881007).

In some embodiments, the antibodies and antigen-binding antibody fragments provided herein may also bind to and neutralize existing bat CoV or pre-emergent bat CoVs. Antibodies and antigen-binding antibody fragments with such binding and/or neutralization abilities would be particularly useful in a future pandemic that may be caused by a spillover from an animal reservoir, like a bat. In fact, ADI-55688, ADI-55689, ADI-55993, ADI-5600, ADI-56046, ADI-55690, ADI-56010, and ADI-55951 were shown to neutralize authentic bat coronavirus, WIV1 (see FIG. 3E of Wec A. et al., Science. Jun. 15, 2020; eabc7424. doi: 10.1126/science.abc7424).

Alternatively, the S proteins of CoV to which the antibodies or antigen-binding antibody fragments of the present disclosure may specifically bind to and neutralize pre-emergent coronaviruses from other species, e.g., bats.

Still alternatively, the S proteins of CoV to which the antibodies or antigen-binding antibody fragments of the present disclosure may specifically bind to may include, for example, Middle East respiratory syndrome coronavirus isolate Riyadh_2_2012 (GenBank Accession No. KF600652.1), Middle East respiratory syndrome coronavirus isolate Al-Hasa_18_2013 (GenBank Accession No. KF600651.1), Middle East respiratory syndrome coronavirus isolate Al-Hasa_17_2013 (GenBank Accession No. KF600647.1), Middle East respiratory syndrome coronavirus isolate Al-Hasa_15_2013 (GenBank Accession No. KF600645.1), Middle East respiratory syndrome coronavirus isolate Al-Hasa_16_2013 (GenBank Accession No. KF600644.1), Middle East respiratory syndrome coronavirus isolate Al-Hasa_21_2013 (GenBank Accession No. KF600634), Middle East respiratory syndrome coronavirus isolate Al-Hasa_19_2013 (GenBank Accession No. KF600632), Middle East respiratory syndrome coronavirus isolate Buraidah_1_2013 (GenBank Accession No. KF600630.1), Middle East respiratory syndrome coronavirus isolate Hafr-Al-Batin_1_2013 (GenBank Accession No. KF600628.1), Middle East respiratory syndrome coronavirus isolate Al-Hasa_12_2013 (GenBank Accession No. KF600627.1), Middle East respiratory syndrome coronavirus isolate Bisha_1_2012 (GenBank Accession No. KF600620.1), Middle East respiratory syndrome coronavirus isolate Riyadh_3_2013 (GenBank Accession No. KF600613.1), Middle East respiratory syndrome coronavirus isolate Riyadh_1_2012 (GenBank Accession No. KF600612.1), Middle East respiratory syndrome coronavirus isolate Al-Hasa_3_2013 (GenBank Accession No. KF186565.1), Middle East respiratory syndrome coronavirus isolate Al-Hasa 1_2013 (GenBank Accession No. KF186567.1), Middle East respiratory syndrome coronavirus isolate Al-Hasa 2_2013 (GenBank Accession No. KF186566.1), Middle East respiratory syndrome coronavirus isolate Al-Hasa 4_2013 (GenBank Accession No. KF186564.1), Middle East respiratory syndrome coronavirus (GenBank Accession No. KF192507.1), *Betacoronavirus* England 1-N1 (GenBank Accession No. NC_019843), MERS-CoV_SA-N1 (GenBank Accession No. KC667074), following isolates of Middle East Respiratory Syndrome Coronavirus (GenBank Accession No: KF600656.1, GenBank Accession No: KF600655.1, GenBank Accession No: KF600654.1, GenBank Accession No: KF600649.1, GenBank Accession No: KF600648.1, GenBank Accession No: KF600646.1, GenBank Accession No: KF600643.1, GenBank Accession No: KF600642.1, GenBank Accession No: KF600640.1, GenBank Accession No: KF600639.1, GenBank Accession No: KF600638.1, GenBank Accession No: KF600637.1, GenBank Accession No: KF600636.1, GenBank Accession No: KF600635.1, GenBank Accession No: KF600631.1, GenBank Accession No: KF600626.1, GenBank Accession No: KF600625.1, GenBank Accession No: KF600624.1, GenBank Accession No: KF600623.1, GenBank Accession No: KF600622.1, GenBank Accession No: KF600621.1, GenBank Accession No: KF600619.1, GenBank Accession No: KF600618.1, GenBank Accession No: KF600616.1, GenBank Accession No: KF600615.1, GenBank Accession No: KF600614.1, GenBank Accession No: KF600641.1, GenBank Accession No: KF600633.1, GenBank Accession No: KF600629.1, GenBank Accession No: KF600617.1), Coronavirus Neoromicia/PML-PHE1/RSA/2011 GenBank Accession: KC869678.2, Bat Coronavirus Taper/CII_KSA_287/Bisha/Saudi Arabia/GenBank Accession No: KF493885.1, Bat coronavirus Rhhar/CI-I_KSA_003/Bisha/Saudi Arabia/2013 GenBank Accession No: KF493888.1, Bat coronavirus Pikuh/CII_KSA_001/Riyadh/Saudi Arabia/2013 GenBank Accession No: KF493887.1, Bat coronavirus Rhhar/CII_KSA_002/Bisha/Saudi Arabia/2013 GenBank Accession No: KF493886.1, Bat Coronavirus Rhhar/CII_KSA_004/Bisha/Saudi Arabia/2013 GenBank Accession No: KF493884.1, BtCoV.HKU4.2 (GenBank Accession No. EF065506), BtCoV.HKU4.1 (GenBank Accession No. NC_009019), BtCoV.HKU4.3 (GenBank Accession No. EF065507), BtCoV.HKU4.4 (GenBank Accession No. EF065508), BtCoV 133.2005 (GenBank Accession No. NC 008315), BtCoV.HKU5.5 (GenBank Accession No. EF065512); BtCoV.HKU5.1 (GenBank Accession No. NC_009020), BtCoV.HKU5.2 (GenBank Accession No. EF065510), BtCoV.HKU5.3 (GenBank Accession No. EF065511), human betacoronavirus 2c Jordan-N3/2012 (GenBank Accession No. KC776174.1; human betacoronavirus 2c EMC/2012 (GenBank Accession No. JX869059.2), *Pipistrellus* bat coronavirus HKU5 isolates (GenBank Accession No:KC522089.1, GenBank Accession No:KC522088.1, GenBank Accession No:KC522087.1, GenBank Accession No:KC522086.1, GenBank Accession No:KC522085.1, GenBank Accession No: KC522084.1, GenBank Accession No:KC522083.1, GenBank Accession No:KC522082.1, GenBank Accession No:KC522081.1, GenBank Accession No:KC522080.1, GenBank Accession No:KC522079.1, GenBank Accession No:KC522078.1, GenBank Accession No: KC522077.1, GenBank Accession No:KC522076.1, GenBank Accession No:KC522075.1, GenBank Accession No:KC522104.1, GenBank Accession No:KC522104.1, GenBank Accession No:KC522103.1, GenBank Accession No:KC522102.1, GenBank Accession No: KC522101.1, GenBank Accession No:KC522100.1, GenBank Accession No:KC522099.1, GenBank Accession No:KC522098.1, GenBank Accession No:KC522097.1, GenBank Accession No:KC522096.1, GenBank Accession No:KC522095.1, GenBank Accession No: KC522094.1, GenBank Accession No:KC522093.1, GenBank Accession No:KC522092.1, GenBank Accession No:KC522091.1, GenBank Accession No:KC522090.1, GenBank Accession No:KC522119.1 GenBank Accession No:KC522118.1 GenBank Accession No: KC522117.1 GenBank Accession No:KC522116.1 GenBank Accession No:KC522115.1 GenBank Accession No:KC522114.1 GenBank Accession No:KC522113.1 GenBank Accession No:KC522112.1 GenBank Accession No:KC522111.1 GenBank Accession No: KC522110.1 GenBank Accession No:KC522109.1 GenBank Accession No:KC522108.1, GenBank Accession No:KC522107.1, GenBank Accession No:KC522106.1, GenBank Accession No:KC522105.1) Pipistrellus bat coronavirus HKU4 isolates (GenBank Accession No:KC522048.1, GenBank Accession No:KC522047.1, GenBank Accession No:KC522046.1, GenBank Accession No:KC522045.1, GenBank Accession No: KC522044.1, GenBank Accession No:KC522043.1, GenBank Accession No:KC522042.1, GenBank Accession No:KC522041.1, GenBank Accession No:KC522040.1

GenBank Accession No:KC522039.1, GenBank Accession No:KC522038.1, GenBank Accession No:KC522037.1, GenBank Accession No:KC522036.1, GenBank Accession No:KC522048.1 GenBank Accession No:KC522047.1 GenBank Accession No:KC522046.1 GenBank Accession No:KC522045.1 GenBank Accession No:KC522044.1 GenBank Accession No:KC522043.1 GenBank Accession No:KC522042.1 GenBank Accession No:KC522041.1 GenBank Accession No:KC522040.1, GenBank Accession No:KC522039.1 GenBank Accession No:KC522038.1 GenBank Accession No:KC522037.1 GenBank Accession No:KC522036.1, GenBank Accession No:KC522061.1 GenBank Accession No:KC522060.1 GenBank Accession No:KC522059.1 GenBank Accession No:KC522058.1 GenBank Accession No:KC522057.1 GenBank Accession No:KC522056.1 GenBank Accession No:KC522055.1 GenBank Accession No:KC522054.1 GenBank Accession No:KC522053.1 GenBank Accession No:KC522052.1 GenBank Accession No:KC522051.1 GenBank Accession No:KC522050.1 GenBank Accession No:KC522049.1 GenBank Accession No:KC522074.1, GenBank Accession No:KC522073.1 GenBank Accession No:KC522072.1 GenBank Accession No:KC522071.1 GenBank Accession No:KC522070.1 GenBank Accession No:KC522069.1 GenBank Accession No:KC522068.1 GenBank Accession No:KC522067.1, GenBank Accession No:KC522066.1 GenBank Accession No:KC522065.1 GenBank Accession No:KC522064.1, GenBank Accession No:KC522063.1, or GenBank Accession No:KC522062.1.

Alternatively, the S proteins of CoV to which the antibodies or antigen-binding antibody fragments of the present disclosure may specifically bind may include for example, FCov.FIPV.79.1146.VR.2202 (GenBank Accession No. NV_007025), transmissible gastroenteritis virus (TGEV) (GenBank Accession No. NC_002306; GenBank Accession No. Q811789.2; GenBank Accession No. DQ811786.2; GenBank Accession No. DQ811788.1; GenBank Accession No. DQ811785.1; GenBank Accession No. X52157.1; GenBank Accession No. AJ011482.1; GenBank Accession No. KC962433.1; GenBank Accession No. AJ271965.2; GenBank Accession No. JQ693060.1; GenBank Accession No. KC609371.1; GenBank Accession No. JQ693060.1; GenBank Accession No. JQ693059.1; GenBank Accession No. JQ693058.1; GenBank Accession No. JQ693057.1; GenBank Accession No. JQ693052.1; GenBank Accession No. JQ693051.1; GenBank Accession No. JQ693050.1), or porcine reproductive and respiratory syndrome virus (PRRSV) (GenBank Accession No. NC_001961.1; GenBank Accession No. DQ811787).

Alternatively, the S proteins of CoV to which the antibodies or antigen-binding antibody fragments of the present disclosure may specifically bind may include, for example, BtCoV.1A.AFCD62 (GenBank Accession No. NC_010437), BtCoV.1B.AFCD307 (GenBank Accession No. NC_010436), BtCov.HKU8.AFCD77 (GenBank Accession No. NC_010438), BtCoV.512.2005 (GenBank Accession No. DQ648858), porcine epidemic diarrhea virus PEDV.CV777 (GenBank Accession No. NC_003436, GenBank Accession No. DQ355224.1, GenBank Accession No. DQ355223.1, GenBank Accession No. DQ355221.1, GenBank Accession No. JN601062.1, GenBank Accession No. N601061.1, GenBank Accession No. JN601060.1, GenBank Accession No. JN601059.1, GenBank Accession No. JN601058.1, GenBank Accession No. JN601057.1, GenBank Accession No. JN601056.1, GenBank Accession No. JN601055.1, GenBank Accession No. JN601054.1, GenBank Accession No. JN601053.1, GenBank Accession No. JN601052.1, GenBank Accession No. JN400902.1, GenBank Accession No. JN547395.1, GenBank Accession No. FJ687473.1, GenBank Accession No. FJ687472.1, GenBank Accession No. FJ687471.1, GenBank Accession No. FJ687470.1, GenBank Accession No. FJ687469.1, GenBank Accession No. FJ687468.1, GenBank Accession No. FJ687467.1, GenBank Accession No. FJ687466.1, GenBank Accession No. FJ687465.1, GenBank Accession No. FJ687464.1, GenBank Accession No. FJ687463.1, GenBank Accession No. FJ687462.1, GenBank Accession No. FJ687461.1, GenBank Accession No. FJ687460.1, GenBank Accession No. FJ687459.1, GenBank Accession No. FJ687458.1, GenBank Accession No. FJ687457.1, GenBank Accession No. FJ687456.1, GenBank Accession No. FJ687455.1, GenBank Accession No. FJ687454.1, GenBank Accession No. FJ687453 GenBank Accession No. FJ687452.1, GenBank Accession No. FJ687451.1, GenBank Accession No. FJ687450.1, GenBank Accession No. FJ687449.1, GenBank Accession No. AF500215.1, GenBank Accession No. KF476061.1, GenBank Accession No. KF476060.1, GenBank Accession No. KF476059.1, GenBank Accession No. KF476058.1, GenBank Accession No. KF476057.1, GenBank Accession No. KF476056.1, GenBank Accession No. KF476055.1, GenBank Accession No. KF476054.1, GenBank Accession No. KF476053.1, GenBank Accession No. KF476052.1, GenBank Accession No. KF476051.1, GenBank Accession No. KF476050.1, GenBank Accession No. KF476049.1, GenBank Accession No. KF476048.1, GenBank Accession No. KF177258.1, GenBank Accession No. KF177257.1, GenBank Accession No. KF177256.1, GenBank Accession No. KF177255.1), HCoV.229E (GenBank Accession No. NC_002645), HCoV.NL63.Amsterdam.I (GenBank Accession No. NC_005831), BtCoV.HKU2.HK.298.2006 (GenBank Accession No. EF203066), BtCoV.HKU2.HK.33.2006 (GenBank Accession No. EF203067), BtCoV.HKU2.HK.46.2006 (GenBank Accession No. EF203065), or BtCoV.HKU2.GD.430.2006 (GenBank Accession No. EF203064).

Alternatively, the S proteins of CoV to which the antibodies or antigen-binding antibody fragments of the present disclosure may specifically bind may include, for example, HCoV.HKU1.C.N5 (GenBank Accession No. DQ339101), MHV.A59 (GenBank Accession No. NC 001846), PHEV.VW572 (GenBank Accession No. NC 007732), HCoV.0C43.ATCC.VR.759 (GenBank Accession No. NC_005147), or bovine enteric coronavirus (BCoV.ENT) (GenBank Accession No. NC_003045).

Alternatively, the S proteins of CoV to which the antibodies or antigen-binding antibody fragments of the present disclosure may specifically bind may include, for example, BtCoV.HKU9.2 (GenBank Accession No. EF065514), BtCoV.HKU9.1 (GenBank Accession No. NC_009021), BtCoV.HkU9.3 (GenBank Accession No. EF065515), or BtCoV.HKU9.4 (GenBank Accession No. EF065516).

In some instances, an anti-CoV-S antibody or antigen-binding fragment thereof according to the disclosure binds to CoV-S (e.g., SARS-CoV-S and/or SARS-CoV-2-S, and/or any of the CoV S proteins listed above) with a dissociation constant (KD) of (i) 100 nM or lower; (ii) about 10 nM or lower; (iii) about 1 nM or lower; (iv) about 100 pM or lower; (v) about 10 pM or lower; (vi) about 1 pM or lower; or (vii) about 0.1 pM or lower.

The present disclosure provides exemplary antibodies or antigen-binding fragments thereof that bind CoV-S, including human CoV-S, which optionally may be affinity-matured. Other antibodies or antigen-binding fragments thereof that bind CoV-S, including those having different CDRs, and epitopic specificity may be obtained using the disclosure of the present specification, and using methods that are generally known in the art. Such antibodies and antigen-binding fragments thereof antagonize the biological effects of CoV-S in vivo and therefore are useful in treating or preventing COV-S-related conditions including, particularly coronavirus infection. In preferred embodiments, the antibody or antigen-binding fragment thereof according to the disclosure comprises one or more CDRs, a $V_L$ chain and/or $V_H$ chain of the anti-CoV-S antibodies and antigen-binding fragments thereof described herein.

In some embodiments, an anti-CoV-S antibody or antigen-binding fragment thereof according to the disclosure will interfere with, block, reduce, or modulate the interaction between COV-S and its receptor(s) (e.g., ACE2, CD209L, L-SIGN, DPP4, or CD26) on host cells or a S protein-priming protein on host cells (e.g., TMPRSS2). If binding of the S protein to its receptor is blocked or reduced, CoV virions may be prohibited from entering the cells, i.e., infection to further cells is prevented. Also, if the S protein is prevented from binding to a S protein-priming protein, the S protein would not be activated and therefore the host cell entry via the receptor may be reduced, i.e., infection to further cells is prevented.

In some instance, an anti-CoV-S antibody or antigen-binding fragment thereof according to the disclosure is "neutralizing", e.g., it substantially or totally prevents the specific interaction of CoV-S with the host receptors or priming protein. As a result, CoV virions may be substantially or totally cleared by immune cells of the host, such as phagocytes via, for example, Fc receptor mediated phagocytosis or mere phagocytosis due to increased time of virions outside the cells. In some embodiments, the antibody or antigen-binding fragment thereof neutralizes CoV-S, e.g., by remaining bound to CoV-S in a location and/or manner that prevents CoV-S from specifically binding to its receptor or priming protein on host cells. As a result, CoV virions may be substantially or totally prevented from entering the cells, i.e. infection to further cells is prevented. In certain embodiments, an anti-CoV-S antibody or antigen-binding fragment thereof according to the disclosure neutralizes CoV (e.g., SARS-CoV and/or SARS-CoV-2) at an IC50 of about 100 nM or lower, of about 50 nM or lower, of about 20 nM or lower, of about 10 nM or lower, of about 5 nM or lower, of about 2 nM or lower, of about 1 nM or lower, of about 500 pM or lower, of about 200 pM or lower, of about 100 pM or lower, of about 50 pM or lower, of about 20 pM or lower, of about 10 pM or lower, of about 5 pM or lower, of about 2 pM or lower, or of about 1 pM or lower, or at an IC50 of about 500 ng/mL or lower, of about 200 ng/mL or lower, of about 100 ng/mL or lower, of about 50 ng/mL or lower, at about 20 ng/mL or lower, at about 10 ng/mL or lower, at about 20 ng/mL or lower, at about 10 mg/mL or lower, at about 5 ng/mL or lower, at about 2 ng/mL or lower, or at about 1 ng/mL or lower, in vitro, as measured by any of the neutralization assays described in Examples herein.

In some instances, an anti-CoV-S antibody or antigen-binding fragment thereof according to the disclosure or cocktail thereof, when administered to a coronavirus infected host or one susceptible to coronavirus infection such as a health care worker may promote a neutralization response in the host against the coronavirus which is sufficient to permit the host to be able to mount an effective cell-mediated immune response against the virus, e.g., T cell-mediated or cytokine-mediated immune response against the coronavirus and/or to be more responsive to other treatment methods such as drugs, antivirals or other biologics.

As mentioned, the anti-CoV-S antibodies or antigen-binding fragments thereof according to the disclosure have a variety of uses. For example, the subject antibodies and fragments can be useful in prophylactic or therapeutic applications, as well as diagnostically in binding assays. The subject anti-CoV-S antibodies or antigen-binding fragments thereof are useful for affinity purification of CoV-S, in particular human CoV-S or its ligands and in screening assays to identify other antagonists of CoV-S activity. Some of the antibodies or antigen-binding fragments thereof are useful for inhibiting binding of CoV-S to its receptor(s) (e.g., ACE2, CD209L, L-SIGN, DPP4, or CD26) on host cells or a S protein-priming protein on host cells (e.g., TMPRSS2) or inhibiting COV-S-mediated activities and/or biological effects.

As used herein, the term one or more biological effects associated with COV-S refers to any biological effect mediated, induced, or otherwise attributable to COV-S, e.g., binding properties, functional properties, and other properties of biological significance. Non-limiting exemplary biological effects of COV-S include COV-S binding to its receptor(s) (e.g., ACE2, CD209L, L-SIGN, DPP4, or CD26) on host cells or a S protein-priming protein on host cells (e.g., TMPRSS2), activation of host cells for allowing virus entry, activation of immune cells as a result of the entry of CoV into the cell, e.g., via presentation of CoV antigen(s) on the host cells' MHC molecule, and resulting inflammation. The subject anti-CoV-S antibodies are capable of inhibiting one, a combination of, or all of these exemplary CoV-S biological activities. For example, the anti-CoV-S antibodies and antigen-binding fragments thereof provided herein may neutralize CoV virions or reduce the infectivity of CoV virions.

The antibody or antigen-binding fragment thereof according to the disclosure can be used in a variety of therapeutic applications. For example, in some embodiments the anti-CoV-S antibody or antigen-binding fragment thereof are useful for treating conditions associated with CoV-S, such as, but not limited to, symptoms associated with CoV infection. The CoV may be any CoV, including SARS-CoV, SARS-CoV-2, MERS-CoV, HCoV-HKU1, HCoV-OC43, HCoV-229E, and HCoV-NL63, and also may be any of the CoV species listed above herein.

Specific examples of CoV infection-associated symptoms are fever, cough, dry cough, shortness of breath or difficulty of breath, fatigue, aches, runny nose, congestion, sore throat, conjunctivitis, chest pain, headache, muscle ache, chills, loss of smell, and loss of taste, and gastrointestinal symptoms including diarrhea. Complications and/or diseases/disorders associated with coronavirus infection may include, for example, bronchitis, pneumonia, respiratory failure, acute respiratory failure, organ failure, multi-organ system failure, pediatric inflammatory multisystem syndrome, acute respiratory distress syndrome (a severe lung condition that causes low oxygen in the blood and organs), blood clots, cardiac conditions, myocardial injury, myocarditis, heart failure, cardiac arrest, acute myocardial infarction, dysrhythmias, venous thromboembolism, post-intensive care syndrome, shock, anaphylactic shock, cytokine release syndrome, septic shock, disseminated intravascular coagulation, ischemic stroke, intracerebral hemorrhage, microangiopathic thrombosis, psychosis, seizure, nonconvulsive status epilepticus, traumatic brain injury, stroke, anoxic brain injury, encephalitis, posterior reversible leukoencephalopathy, necrotizing encephalopathy, post-infectious encephalitis, autoimmune mediated encephalitis, acute disseminated encephalomyelitis, acute kidney injury, acute liver injury, pancreatic injury, immune thrombocytopenia, subacute thyroiditis, gastrointestinal complications, aspergillosis, increased susceptibility to infection with another virus or bacteria, and/or pregnancy-related complications. Certain diseases and conditions, such as high blood pressure, type 1 diabetes, liver disease, overweight, chronic lung diseases including cystic fibrosis, pulmonary fibrosis, and asthma, compromised immune system due to transplant, use of an immunosuppressant, or HIV infection, and brain and nervous system condition, may increase the risk of CoV infection-associated complications and diseases.

The subject anti-CoV-S antibodies and antigen-binding fragments thereof may be used alone or in association with other active agents or drugs, including other biologics, to treat any subject in which blocking, inhibiting, or neutralizing the in vivo effect of CoV-S or blocking or inhibiting the interaction of CoV-S and its receptor(s) (e.g., ACE2, CD209L, L-SIGN, DPP4, or CD26) on host cells or a S protein-priming protein on host cells (e.g., TMPRSS2), is therapeutically desirable. In some embodiment, the subject anti-CoV-S antibody and antigen-binding fragment thereof, e.g., ADI-58125, may be used in combination with a second antibody, or antigen-binding fragment thereof, wherein the second antibody, or antigen-binding fragment thereof, is selected from the group consisting of ADI-58122, ADI-58127, ADI-58129, ADI-58131, or a combination thereof. In some embodiment, the second antibody, or antigen-binding fragment thereof, is ADI-58122. In one embodiment, the second antibody, or antigen-binding fragment thereof, is ADI-58127. In one embodiment, the second antibody, or antigen-binding fragment thereof, is ADI-58129. In one embodiment, the second antibody, or antigen-binding fragment thereof, is ADI-58131.

Exemplary anti-CoV antibodies and antigen-binding fragments thereof according to the disclosure, and the specific CDRs thereof are identified in this section. For convenience, each exemplified antibody or antigen-binding fragment thereof, and corresponding sequences are separately identified by a specific nomenclature, as shown in FIGS. 1, 2 and 36.

The anti-CoV-S antibodies and antigen-binding fragments thereof comprising the disclosure have binding affinity for CoV-S, such as SARS-CoV-S or SARS-CoV-S2. Some antibodies of the present disclosure bind to SARS-CoV-S or SARS-CoV-S2 with a similar $K_D$ (M), while some antibodies of the present disclosure bind to SARS-CoV-S with a lower $K_D$ (M) (i.e., higher affinity) than to SARS-CoV-S2, and some antibodies of the present disclosure bind to SARS-CoV-S-2 with a lower $K_D$ (M) (i.e., higher affinity) than to SARS-CoV-S. Affinities to different CoV-S proteins for antibodies are provided in FIGS. 7-12 and 14.

C. Anti-CoV-S Antibody Polypeptide Sequences and Nucleic Acid Sequences Encoding Thereof Antibodies Disclosed Herein Anti-CoV-S antibodies, and antigen-binding fragments thereof, specifically provided herein include: antibodies ADI-55688, ADI-55689, ADI-55690, ADI-55691, ADI-55692, ADI-55693, ADI-55694, ADI-55695, ADI-55696, ADI-55697, ADI-55698, ADI-55699, ADI-55700, ADI-55701, ADI-55702, ADI-55703, ADI-55704, ADI-55705, ADI-55706, ADI-55707, ADI-55708, ADI-55709, ADI-55710, ADI-55711, ADI-55712, ADI-55713, ADI-55714, ADI-55715, ADI-55716, ADI-55717, ADI-55718, ADI-55719, ADI-55721, ADI-55722, ADI-55723, ADI-55724, ADI-55725, ADI-55726, ADI-55727, ADI-55728, ADI-55729, ADI-55730, ADI-55731, ADI-55732, ADI-55733, ADI-55734, ADI-55735, ADI-55736, ADI-55737, ADI-55738, ADI-55739, ADI-55740, ADI-55741, ADI-55742, ADI-55743, ADI-55744, ADI-55745, ADI-55746, ADI-55747, ADI-55748, ADI-55749, ADI-55750, ADI-55751, ADI-55752, ADI-55753, ADI-55754, ADI-55755, ADI-55756, ADI-55757, ADI-55758, ADI-55720, ADI-55760, ADI-55761, ADI-55762, ADI-55763, ADI-55765, ADI-55766, ADI-55767, ADI-55769, ADI-55770, ADI-55771, ADI-55775, ADI-55776, ADI-55777, ADI-55950, ADI-55951, ADI-55952, ADI-55953, ADI-55954, ADI-55955, ADI-55956, ADI-55957, ADI-55958, ADI-55959, ADI-55960, ADI-55961, ADI-55962, ADI-55963, ADI-55964, ADI-55965, ADI-55966, ADI-55967, ADI-55968, ADI-55969, ADI-55970, ADI-55972, ADI-55973, ADI-55974, ADI-55975, ADI-55976, ADI-55977, ADI-55978, ADI-55979, ADI-55980, ADI-55981 ADI-55982, ADI-55984, ADI-55986, ADI-55988, ADI-55989, ADI-55990, ADI-55992, ADI-55993, ADI-55994, ADI-55995, ADI-55996, ADI-55997, ADI-55998, ADI-55999, ADI-56000, ADI-56001, ADI-56002, ADI-56003, ADI-56004, ADI-56005 ADI-56006, ADI-56007, ADI-56008, ADI-56009, ADI-56010, ADI-56011, ADI-56012, ADI-56013, ADI-56014, ADI-56015, ADI-56016, ADI-56017, ADI-56018, ADI-56019, ADI-56020, ADI-56021, ADI-56022, ADI-56023, ADI-56024, ADI-56025, ADI-56026, ADI-56027, ADI-56028, ADI-56029, ADI-56030, ADI-56031, ADI-56032, ADI-56033, ADI-56034, ADI-56035, ADI-56037, ADI-56038, ADI-56039, ADI-56040, ADI-56041, ADI-56042, ADI-56043, ADI-56044, ADI-56045, ADI-56046, ADI-56047, ADI-56048, ADI-56049, ADI-56050, ADI-56051, ADI-56052, ADI-56053, ADI-56054, ADI-56055, ADI-56056, ADI-56057, ADI-56058, ADI-56059, ADI-56061, ADI-56062, ADI-56063, ADI-56064, ADI-56065, ADI-56066, ADI-56067, ADI-56068, ADI-56069, ADI-56070, ADI-56071, ADI-56072, ADI-56073, ADI-56074, ADI-56075 ADI-56076, ADI-56078, ADI-56079, ADI-56080, ADI-56081, ADI-56082, ADI-56083, ADI-56084, ADI-57983 (with primer mutation), ADI-57978 (with primer mutation), ADI-56868 (with primer mutation), ADI-56443 (with primer mutation), ADI-56479 (with primer mutation), ADI-58120, ADI-58121, ADI-58122, ADI-58123, ADI-58124, ADI-58125, ADI-58126, ADI-58127, ADI-58128, ADI-58129, ADI-58130, ADI-58131, ADI-58130_LCN30cQ, or ADI-59988, as shown in FIGS. 1, 2, and 36, and antigen-binding fragments thereof. Any Fc variant including but not limited to those specifically disclosed in Table 1 may be used in combination with any of the variable sequences disclosed herein. In some embodiments, the Fc variant is an LA variant and comprises the amino acid sequence of SEQ ID NO: 13. In one embodiment, the antibody ADI-58125 comprises an Fc variant of SEQ ID NO:13.

FIGS. 1, 2 and 36 show the SEQ ID NOs assigned to individual amino acid sequences of the VH, VH FR1, VH CDR1, VH FR2, VH CDR2, VH FR3, VH CDR3, VH FR4, VL, VL FR1, VL CDR1, VL FR2, VL CDR2, VL FR3, VL CDR3, and VL FR4 for individual antibodies, and the SEQ ID NOs assigned to the nucleic acid sequences of the VH and VL of individual antibodies.

For example, for antibody ADI-55688:
(i) the VH of ADI-55688 comprises the amino acid sequence of SEQ ID NO: 102;
(ii) the VH FR1 of ADI-55688 comprises the amino acid sequence of SEQ ID NO: 103;
(iii) the VH CDR1 of ADI-55688 comprises the amino acid sequence of SEQ ID NO: 104;
(iv) the VH FR2 of ADI-55688 comprises the amino acid sequence of SEQ ID NO: 105;
(v) the VH CDR2 of ADI-55688 comprises the amino acid sequence of SEQ ID NO: 106;
(vi) the VH FR3 of ADI-55688 comprises the amino acid sequence of SEQ ID NO: 107;
(vii) the VH CDR3 of ADI-55688 comprises the amino acid sequence of SEQ ID NO: 108;
(viii) the VH FR4 of ADI-55688 comprises the amino acid sequence of SEQ ID NO: 109;
(ix) the VH of ADI-55688 is encoded by the nucleic acid sequence of SEQ ID NO: 110;
(x) the VL of ADI-55688 comprises the amino acid sequence of SEQ ID NO: 112;
(xi) the VL FR1 of ADI-55688 comprises the amino acid sequence of SEQ ID NO: 113;
(xii) the VL CDR1 of ADI-55688 comprises the amino acid sequence of SEQ ID NO: 114;
(xiii) the VL FR2 of ADI-55688 comprises the amino acid sequence of SEQ ID NO: 115;
(xiv) the VL CDR2 of ADI-55688 comprises the amino acid sequence of SEQ ID NO: 116;
(xv) the VL FR3 of ADI-55688 comprises the amino acid sequence of SEQ ID NO: 117;
(xvi) the VL CDR3 of ADI-55688 comprises the amino acid sequence of SEQ ID NO: 118.
(xvii) the VL FR4 of ADI-55688 comprises the amino acid sequence of SEQ ID NO: 119; and
(xviii) the VL of ADI-55688 is encoded by the nucleic acid sequence of SEQ ID NO: 120.

Analogously, for antibody ADI-55689:
(i) the VH of ADI-55689 comprises the amino acid sequence of SEQ ID NO: 202;
(ii) the VH FR1 of ADI-55689 comprises the amino acid sequence of SEQ ID NO: 203;
(iii) the VH CDR1 of ADI-55689 comprises the amino acid sequence of SEQ ID NO: 204;
(iv) the VH FR2 of ADI-55689 comprises the amino acid sequence of SEQ ID NO: 205;
(v) the VH CDR2 of ADI-55689 comprises the amino acid sequence of SEQ ID NO: 206;
(vi) the VH FR3 of ADI-55689 comprises the amino acid sequence of SEQ ID NO: 207;
(vii) the VH CDR3 of ADI-55689 comprises the amino acid sequence of SEQ ID NO: 208;
(viii) the VH FR4 of ADI-55689 comprises the amino acid sequence of SEQ ID NO: 209;
(ix) the VH of ADI-55689 is encoded by the nucleic acid sequence of SEQ ID NO: 210;
(x) the VL of ADI-55689 comprises the amino acid sequence of SEQ ID NO: 212;
(xi) the VL FR1 of ADI-55689 comprises the amino acid sequence of SEQ ID NO: 213;
(xii) the VL CDR1 of ADI-55689 comprises the amino acid sequence of SEQ ID NO: 214;
(xiii) the VL FR2 of ADI-55689 comprises the amino acid sequence of SEQ ID NO: 215;
(xiv) the VL CDR2 of ADI-55689 comprises the amino acid sequence of SEQ ID NO: 216;
(xv) the VL FR3 of ADI-55689 comprises the amino acid sequence of SEQ ID NO: 217;
(xvi) the VL CDR3 of ADI-55689 comprises the amino acid sequence of SEQ ID NO: 218;
(xvii) the VL FR4 of ADI-55689 comprises the amino acid sequence of SEQ ID NO: 219; and
(xviii) the VL of ADI-55689 is encoded by the nucleic acid sequence of SEQ ID NO: 220.

The corresponding amino acid and nucleic acid sequences and sequence identifiers for such sequences and isotype for all other antibodies are disclosed in FIGS. 1, 2 and 36.

Variations of the Disclosed Antibodies and Polynucleotide Sequences Encoding Such Variations In one embodiment, disclosed herein are anti-CoV-S antibodies or antigen-binding antibody fragments comprising (i) a VH CDR that is same as the VH CDR3 of, (ii) a VH CDR3 and VL CDR3, both of which as same as both of the VH CDR3 and the VL CDR3 of, (iii) at least 1, 2, 3, 4, 5, or 6 CDRs that are same as the corresponding CDR(s) of, or (iv) 6 CDRs that are all the same as the 6 CDRs of any one of the disclosed antibodies described herein and in FIGS. 1, 2 and 36.

In further embodiments, disclosed herein are anti-CoV-S antibodies or antigen-binding antibody fragments which optionally may be affinity-matured, comprising one of the CDR requirements (i)-(iv) of the immediately above paragraph, further wherein (a) the VH comprises an amino acid sequence with at least 80, 85, 90, 91, 92, 93, 94, 95, 96, 97, 98, 99, or 100% sequence identity to the amino acid sequence of the VH of, and (b) the VL comprises an amino acid sequence with at least 80, 85, 90, 91, 92, 93, 94, 95, 96, 97, 98, 99, or 100% sequence identity to the amino acid sequence of the VL of any one of the disclosed antibodies described herein and in FIGS. 1, 2 and 36.

In further embodiments, the disclosure contemplates anti-CoV-S antibodies or antigen-binding antibody fragments which optionally may be affinity-matured, comprising one of the VH and VL requirements (i)-(iv) of the immediately above paragraph, further wherein (a) the heavy chain comprises an amino acid sequence with at least 80, 85, 90, 91, 92, 93, 94 95, 96, 97, 98, 99, or 100% sequence identity to the amino acid sequence of the heavy chain of, and (b) the light chain comprises an amino acid sequence with at least 80, 85, 90, 91, 92, 93, 94, 95, 96, 97, 98, 99, or 100% sequence identity to the amino acid sequence of the light chain of any one of the disclosed antibodies as described herein and in FIGS. 1, 2 and 36.

In further embodiments, the disclosure contemplates anti-CoV-S antibodies or antigen-binding antibody fragments which optionally may be affinity-matured, comprising one of the CDR requirements (i)-(iv) of the immediately above paragraph, further wherein (a) the VH is identical to the VH of, and (b) the VL is identical to the VL of any one of the disclosed antibodies described herein and in FIGS. 1, 2 and 36.

In other embodiments, the disclosure includes antibodies and antigen-binding fragments which optionally may be affinity-matured, having binding specificity to COV-S that bind the same epitope as one of antibodies described herein and in FIGS. 1, 2 and 36.

In other embodiments, the disclosure includes antibodies and antigen-binding fragments having binding specificity to COV-S, which optionally may be affinity-matured, that bind the same epitope as any one of antibodies described herein and in FIGS. 1, 2 and 36.

In other embodiments, the anti-CoV-S antibodies and antigen-binding fragments optionally may be affinity-matured, comprise, or alternatively consist of, combinations of one or more of the FRs, CDRs, the VH and VL sequences, and the heavy chain and light chain sequences set forth above, including all of them, or sequences that are at least 90%, 91%, 92%, 93%, 94%, 95%, 96%, 97%, 98%, or 99% identical thereto.

In a further embodiment, antigen-binding fragments comprise, or alternatively consist of, Fab fragments having binding specificity for COV-S. The Fab fragment preferably includes the VH and the VL sequence of any one of antibodies as described herein and in FIGS. 1, 2 and 36, or sequences that are at least 90%, 91%, 92%, 93%, 94%, 95%, 96%, 97%, 98%, or 99% identical thereto. This embodiment further includes Fabs containing additions, deletions, and variants of such VH and $V_L$ sequence while retaining binding specificity for COV-S.

In some embodiments, Fab fragments may be produced by enzymatic digestion (e.g., papain) of the parent full antibody. In another embodiment, anti-CoV-S antibodies, such as anyone of antibodies as described herein and in FIGS. 1, 2 and 36, and Fab fragments thereof may be produced via expression in mammalian cells, such as CHO, NSO, or HEK 293 cells, fungal, insect, or microbial systems, such as yeast cells.

In additional embodiments, disclosed herein are polynucleotides encoding antibody polypeptides having binding specificity to COV-S, including the VH and VL of any one of antibodies as described herein and in FIGS. 1, 2 and 36, as well as fragments, variants, optionally affinity-matured variants, and combinations of one or more of the FRs, CDRs, the VH and VL sequences, and the heavy chain and light chain sequences set forth above, including all of them, or sequences that are at least 90%, 91%, 92%, 93%, 94%, 95%, 96%, 97%, 98%, or 99% identical thereto.

In other embodiments, the disclosure contemplates isolated anti-CoV-S antibodies and antigen binding fragments comprising (i) a VH which is same as the VH of any one of antibodies as described herein and in FIGS. 1, 2 and 36; and (ii) a VL which is same as the VL of another antibody as described herein and in FIGS. 1, 2 and 36, or a variant thereof, wherein optionally one or more of the framework region residues ("FR residues") and/or CDR residues in said VH or VL polypeptide has been substituted with another amino acid residue resulting in an anti-CoV-S antibody that specifically binds COV-S.

The disclosure also includes humanized, primatized and other chimeric forms of these antibodies. The chimeric and humanized antibodies may include an Fc derived from IgG1, IgG2, IgG3, or IgG4 constant regions.

In some embodiments, the chimeric or humanized antibodies or fragments or VH or VL polypeptides originate or are derived from one or more human antibodies, e.g., a human antibody identified from a clonal human B cell population.

In some aspects, the disclosure provides vectors comprising a nucleic acid molecule encoding an anti-CoV-S antibody or fragment thereof as disclosed herein. In some embodiments, the disclosure provides host cells comprising a nucleic acid molecule encoding an anti-CoV-S antibody or fragment thereof as disclosed herein.

In some aspects, the disclosure provides isolated antibodies or antigen binding fragments thereof that competes for binding to CoV-S with an antibody or antigen binding fragment thereof disclosed herein.

In some aspects, the disclosure provides a nucleic acid molecule encoding any of the antibodies or antigen binding fragments disclosed herein.

In some aspects, the disclosure provides a pharmaceutical or diagnostic composition comprising at least one antibody or antigen binding fragment thereof as disclosed herein.

In some aspects, the disclosure provides a method for treating or preventing a condition associated with elevated CoV-S levels in a subject, comprising administering to a subject in need thereof an effective amount of at least one isolated antibody or antigen binding fragment thereof as disclosed herein.

In some aspects, the disclosure provides a method of inhibiting binding of COV-S to its receptor (e.g., ACE2, L-SIGN, CD209L, DPP4, CD26) or an S protein-priming protein (e.g., TMPRSS2) in a subject comprising administering an effective amount of at least one antibody or antigen binding fragment thereof as disclosed herein. For example, administering one or more of ADI-55689; ADI-55993; ADI-56000; ADI-56046; ADI-56010; ADI-55688; ADI-56032; ADI-55690; and ADI-55951 may inhibit binding of COV-S to its receptor, e.g., ACE2.

In some aspects, the disclosure provides an antibody or antigen binding fragment thereof that selectively binds to CoV-S, wherein the antibody or antigen binding fragment thereof binds to CoV-S with a $K_D$ of less than or equal to $5 \times 10^{-5}$ M, $10^{-5}$ M, $5 \times 10^{-6}$ M, $10^{-6}$ M, $5 \times 10^{-7}$ M, $10^{-7}$ M, $5 \times 10^{-8}$ M, $10^{-8}$ M, $5 \times 10^{-9}$ M, $10^{-9}$ M, $5 \times 10^{-10}$ M, $10^{-10}$ M, $5 \times 10^{-11}$ M, $10^{-11}$ M, $5 \times 10^{-12}$ M, $10^{+12}$ M, $5 \times 10^{-13}$ M, or $10^{-13}$ M; preferably, with a $K_D$ of less than or equal to $5 \times 10^{-10}$ M, $10^{-10}$ M, $5 \times 10^{-11}$ M, $10^{-11}$ M, $5 \times 10^{-12}$ M, or $10^{-12}$ M; more preferably, with a $K_D$ that is less than about 100 pM, less than about 50 pM, less than about 40 pM, less than about 25 pM, less than about 1 pM, between about 10 pM and about 100 pM, between about 1 pM and about 100 pM, or between about 1 pM and about 10 pM. Preferably, the anti-CoV-S antibody or antigen binding fragment has cross-reactivity to the S protein of CoV other than SARS-CoV-S or SARS-CoV-2-S.

The inventive antibodies and antigen binding fragments thereof may be modified post-translationally to add effector moieties such as chemical linkers, detectable moieties such as for example fluorescent dyes, enzymes, substrates, bioluminescent materials, radioactive materials, and chemiluminescent moieties, or functional moieties such as for example streptavidin, avidin, biotin, a cytotoxin, a cytotoxic agent, and radioactive materials.

Antibodies and antigen binding fragments thereof may also be chemically modified to provide additional advantages such as increased solubility, stability and circulating time (in vivo half-life) of the polypeptide, or decreased immunogenicity (See U.S. Pat. No. 4,179,337). The chemical moieties for derivatization may be selected from water soluble polymers such as polyethylene glycol, ethylene glycol/propylene glycol copolymers, carboxymethylcellulose, dextran, polyvinyl alcohol, and the like. The antibodies and fragments thereof may be modified at random positions within the molecule, or at predetermined positions within the molecule and may include one, two, three, or more attached chemical moieties.

The polymer may be of any molecular weight, and may be branched or unbranched. For polyethylene glycol, the preferred molecular weight is between about 1 kDa and about 100 kDa (the term "about" indicating that in preparations of polyethylene glycol, some molecules will weigh more, some less, than the stated molecular weight) for ease in handling and manufacturing. Other sizes may be used, depending on the desired therapeutic profile (e.g., the duration of sustained release desired, the effects, if any on biological activity, the ease in handling, the degree or lack of antigenicity and other known effects of the polyethylene glycol to a therapeutic protein or analog). For example, the polyethylene glycol may have an average molecular weight of about 200, 500, 1000, 1500, 2000, 2500, 3000, 3500, 4000, 4500, 5000, 5500, 6000, 6500, 7000, 7500, 8000, 8500, 9000, 9500, 10,000, 10,500, 11,000, 11,500, 12,000, 12,500, 13,000, 13,500, 14,000, 14,500, 15,000, 15,500, 16,000, 16,500, 17,000, 17,500, 18,000, 18,500, 19,000, 19,500, 20,000, 25,000, 30,000, 35,000, 40,000, 50,000, 55,000, 60,000, 65,000, 70,000, 75,000, 80,000, 85,000, 90,000, 95,000, or 100,000 kDa. Branched polyethylene glycols are described, for example, in U.S. Pat. No. 5,643,575; Morpurgo et al., *Appl. Biochem. Biotechnol.*, 56:59-72 (1996); Vorobjev et al., *Nucleosides and Nucleotides*, 18:2745-2750 (1999); and Caliceti et al., *Bioconjug. Chem.*, 10:638-646 (1999), the disclosures of each of which are incorporated herein by reference.

There are a number of attachment methods available to those skilled in the art (See e.g., EP 0 401 384, herein incorporated by reference, disclosing a method of coupling PEG to G-CSF; and Malik et al., *Exp. Hematol.*, 20:1028-1035 (1992) (reporting pegylation of GM-CSF using tresyl chloride)). For example, polyethylene glycol may be covalently bound through amino acid residues via a reactive group, such as, a free amino or carboxyl group. Reactive groups are those to which an activated polyethylene glycol molecule may be bound. The amino acid residues having a free amino group may include lysine residues and the N-terminal amino acid residues; those having a free carboxyl group may include aspartic acid residues glutamic acid residues and the C-terminal amino acid residue. Sulfhydryl groups may also be used as a reactive group for attaching the polyethylene glycol molecules. Preferred for therapeutic purposes is attachment at an amino group, such as attachment at the N-terminus or lysine group.

As described above, polyethylene glycol may be attached to proteins via linkage to any of a number of amino acid residues. For example, polyethylene glycol can be linked to polypeptides via covalent bonds to lysine, histidine, aspartic acid, glutamic acid, or cysteine residues. One or more reaction chemistries may be employed to attach polyethylene glycol to specific amino acid residues (e.g., lysine, histidine, aspartic acid, glutamic acid, or cysteine) or to more than one type of amino acid residue (e.g., lysine, histidine, aspartic acid, glutamic acid, cysteine and combinations thereof).

Alternatively, antibodies or antigen binding fragments thereof having increased in vivo half-lives may be produced via fusion with albumin (including but not limited to recombinant human serum albumin or fragments or variants thereof (See, e.g., U.S. Pat. No. 5,876,969, EP 0 413 622, and U.S. Pat. No. 5,766,883, herein incorporated by reference in their entirety)), or other circulating blood proteins such as transferrin or ferritin. In a preferred embodiment, polypeptides and/or antibodies of the present disclosure (including fragments or variants thereof) are fused with the mature form of human serum albumin (i.e., amino acids 1-585 of human serum albumin as shown in FIGS. 1 and 2 of EP 0 322 094) which is herein incorporated by reference in its entirety. Polynucleotides encoding fusion proteins of the disclosure are also encompassed by the disclosure.

Regarding detectable moieties, further exemplary enzymes include, but are not limited to, horseradish peroxidase, acetylcholinesterase, alkaline phosphatase, beta-galactosidase, and luciferase. Further exemplary fluorescent materials include, but are not limited to, rhodamine, fluorescein, fluorescein isothiocyanate, umbelliferone, dichlorotriazinylamine, phycoerythrin, and dansyl chloride. Further exemplary chemiluminescent moieties include, but are not limited to, luminol. Further exemplary bioluminescent materials include, but are not limited to, luciferin and aequorin. Further exemplary radioactive materials include, but are not limited to, Iodine 125 ($^{125}$I), Carbon 14 ($^{14}$C), Sulfur 35 ($^{35}$S), Tritium ($^3$H) and Phosphorus 32 ($^{32}$P).

Methods are known in the art for conjugating an antibody or antigen binding fragment thereof to a detectable moiety and the like, such as for example those methods described by Hunter et al., *Nature*, 144:945 (1962); David et al., *Biochemistry*, 13:1014 (1974); Pain et al., *J. Immunol. Meth.*, 40:219 (1981); and Nygren, J., *Histochem. and Cytochem.*, 30:407 (1982).

Embodiments described herein further include variants and equivalents that are substantially homologous to the antibodies, antibody fragments, diabodies, SMIPs, camelbodies, nanobodies, IgNAR, polypeptides, variable regions, and CDRs set forth herein. These may contain, e.g., conservative substitution mutations, (i.e., the substitution of one or more amino acids by similar amino acids). For example, conservative substitution refers to the substitution of an amino acid with another within the same general class, e.g., one acidic amino acid with another acidic amino acid, one basic amino acid with another basic amino acid, or one neutral amino acid by another neutral amino acid. The intent of a conservative amino acid substitution is well known in the art.

In other embodiments, the disclosure contemplates polypeptide sequences having at least 90% or greater sequence homology to any one or more of the polypeptide sequences of antigen binding fragments, variable regions and CDRs set forth herein. More preferably, the disclosure contemplates polypeptide sequences having at least 95% or greater sequence homology, even more preferably at least 98% or greater sequence homology, and still more preferably at least 99% or greater sequence homology to any one or more of the polypeptide sequences of antigen binding fragments, variable regions, and CDRs set forth herein.

Methods for determining homology between nucleic acid and amino acid sequences are well known to those of ordinary skill in the art.

In other embodiments, the disclosure further contemplates the above-recited polypeptide homologs of the antigen binding fragments, variable regions and CDRs set forth herein further having anti-CoV-S activity. Non-limiting examples of anti-CoV-S activity are set forth herein, e.g., ability to inhibit CoV-S binding to its receptor such as ACE2 or L-SIGN or an S protein-priming protein, thereby resulting in the reduced entry of CoV into cells.

In other embodiments, the disclosure further contemplates the generation and use of antibodies that bind any of the foregoing sequences, including, but not limited to, anti-idiotypic antibodies. In an exemplary embodiment, such an anti-idiotypic antibody could be administered to a subject who has received an anti-CoV-S antibody to modulate, reduce, or neutralize, the effect of the anti-CoV-S antibody. Such antibodies could also be useful for treatment of an autoimmune disease characterized by the presence of anti-CoV-S antibodies. A further exemplary use of such antibodies, e.g., anti-idiotypic antibodies, is for detection of the anti-CoV-S antibodies of the present disclosure, for example to monitor the levels of the anti-CoV-S antibodies present in a subject's blood or other bodily fluids. For example, in one embodiment, the disclosure provides a method of using the anti-idiotypic antibody to monitor the in vivo levels of said anti-CoV-S antibody or antigen binding fragment thereof in a subject or to neutralize said anti-CoV-S antibody in a subject being administered said anti-CoV-S antibody or antigen binding fragment thereof.

The present disclosure also contemplates anti-CoV-S antibodies comprising any of the polypeptide or polynucleotide sequences described herein substituted for any of the other polynucleotide sequences described herein. For example, without limitation thereto, the present disclosure contemplates antibodies comprising the combination of any of the VL and VH sequences described herein, and further contemplates antibodies resulting from substitution of any of the CDR sequences described herein for any of the other CDR sequences described herein.

Another embodiment of the disclosure contemplates these polynucleotides incorporated into an expression vector for expression in mammalian cells such as CHO, NSO, or HEK-293 cells, or in fungal, insect, or microbial systems such as yeast cells. In one embodiment of the disclosure described herein, Fab fragments can be produced by enzymatic digestion (e.g., papain) of any one of antibodies as described herein and in FIGS. 1, 2 and 36, following expression of the full-length polynucleotides in a suitable host. In another embodiment, anti-CoV-S antibodies, such as anyone of antibodies as described herein and in FIGS. 1, 2 and 36, or Fab fragments thereof, can be produced via expression of the polynucleotides encoding any one of antibodies as described herein and in FIGS. 1, 2 and 36, preferably, in certain embodiments, ADI-57983 (with primer mutation), ADI-57978 (with primer mutation), ADI-56868 (with primer mutation), ADI-56443 (with primer mutation), ADI-56479 (with primer mutation), ADI-58120, ADI-58121, ADI-58122, ADI-58123, ADI-58124, ADI-58125, ADI-58126, ADI-58127, ADI-58128, ADI-58129, ADI-58130, ADI-58131, ADI-58130_LCN30cQ, or ADI-59988, in mammalian cells such as CHO, NSO, or HEK 293 cells, fungal, insect, or microbial systems such as yeast cells.

Host cells and vectors comprising said polynucleotides are also contemplated.

The disclosure further contemplates vectors comprising the polynucleotide sequences encoding the variable heavy and light chain polypeptide sequences, as well as the individual CDRs (hypervariable regions), as set forth herein, as well as host cells comprising said vector sequences. In one embodiment, the host cells are mammalian cells, such as CHO cells. In one embodiment, the host cells are yeast cells.

D. Antibody-Drug Conjugate Comprising Anti-CoV-S Antibody

In some aspects, the disclosure is further directed to antibody-drug conjugates (ADCs) comprising (a) any antibody or antigen-binding antibody fragment described herein; and (b) a drug conjugated to the antibody or antigen-binding antibody fragment, either directly or indirectly (e.g., via a linker).

In some aspects, the drug may be, but not limited to, a cytotoxic drug, an apoptotic drug, an immunostimulatory drug, an anti-microbial drug, an antibacterial drug or vaccine, an antiviral drug, antihelminth drug, antiparasitic drug, an anti-inflammatory drug, antihistamine, an anti-fibrotic drug, an immunosuppressive drug, a steroid, a bronchodilator, a beta blocker, an ACE inhibitor, an enzyme, a serine protease inhibitor, a toxin, a radioisotope, a compound, a small molecule, a small molecule inhibitor, a protein, a peptide, a vector, a plasmid, a viral particle, a nanoparticle, a DNA molecule, an RNA molecule, an siRNA, an shRNA, a micro RNA, an oligonucleotide, and an imaging drug.

An antiviral drug may be remdesivir, favipiravir, darunavir, nelfinavir, saquinavir, lopinavir or ritonavir; an antihelminth drug may be ivermectin; an antiparasite drug may be hydroxychloroquine, chloroquine, or atovaquone; antibacterial drug or vaccine may be the tuberculosis vaccine BCG; an anti-inflammatory drug, may be ciclesonide, a TNF inhibitor (e.g., adalimumab), a TNF receptor inhibitor (e.g., etanercept), an IL-6 inhibitor (e.g., clazakizumab), an IL-6 receptor inhibitor (e.g., toclizumab), or metamizole; an antihistamine drug may be bepotastine; an ACE inhibitor may be moexipril; and a drug that inhibits priming of CoV-S may be a serine protease inhibitor such as nafamostat.

The toxin may be a bacterial, fungal, plant, or animal toxin, or a fragment thereof. Examples include, but are not limited to, diphtheria A chain, diphtheria toxin, exotoxin A chain, ricin A chain, abrin A chain, modeccin A chain, alpha sarcin, *Aleurites fordii* protein, a dianthin protein, or a *Phytolacca Americana* protein.

The cytotoxic drug or anti-proliferative drug may be, for example, but is not limited to, doxorubicin, daunorubicin, cucurbitacin, chaetocin, chaetoglobosin, chlamydocin, calicheamicin, nemorubicin, cryptophyscin, mensacarcin, ansamitocin, mitomycin C, geldanamycin, mechercharmycin, rebeccamycin, safracin, okilactomycin, oligomycin, actinomycin, sandramycin, hypothemycin, polyketomycin, hydroxyellipticine, thiocolchicine, methotrexate, triptolide, taltobulin, lactacystin, dolastatin, auristatin, monomethyl auristatin E (MMAE), monomethyl auristatin F (MMAF), telomestatin, tubastatin A, combretastatin, maytansinoid, MMAD, MMAF, DM1, DM4, DTT, 16-GMB-APA-GA, 17-DMAP-GA, JW 55, pyrrolobenzodiazepine, SN-38, Ro 5-3335, puwainaphycin, duocarmycin, bafilomycin, taxoid, tubulysin, ferulenol, lusiol A, fumagillin, hygrolidin, glucopiericidin, amanitin, ansatrienin, cinerubin, phallacidin, phalloidin, phytosphongosine, piericidin, poronetin, phodophyllotoxin, gramicidin A, sanguinarine, sinefungin, herboxidiene, microcolin B, microcystin, muscotoxin A, tolytoxin, tripolin A, myoseverin, mytoxin B, nocuolin A, psuedolaric acid B, pseurotin A, cyclopamine, curvulin, colchicine, aphidicolin, englerin, cordycepin, apoptolidin, epothilone A, limaquinone, isatropolone, isofistularin, quinaldopeptin, ixabepilone, aeroplysinin, arruginosin, agrochelin, epothilone, or a derivative thereof (for example, see Polakis P. et al., *Pharmacol Rev.* 2016 January; 68(1):3-19. doi: 10.1124/pr.114.009373) (the drugs may be obtained from many vendors, including Creative Biolabs®).

The radioisotope may be for example, but is not limited to, $At^{211}$, $I^{131}$, $In^{131}$, $I^{125}$, $Y^{90}$, $Re^{186}$, $Re^{188}$, $Sm^{153}$, $Bi^{212}$, $P^{32}$, $Pb^{212}$ and radioactive isotopes of Lu.

In certain embodiments, the drug may be, but is not limited to, MMAE or MMAF.

In some embodiments, the Ab or antigen-binding Ab fragment is directly conjugated to the drug to form an ADC.

In some embodiments, the antibody or antigen-binding antibody fragment is indirectly conjugated to the drug to form an ADC.

Any appropriate conjugation method may be used to generate an ADC (for example, Nolting B. *Methods Mol Biol.* 2013; 1045:71-100; Jain N. et al., *Pharm Res.* 2015 November; 32(11):3526-40; Tsuchikama K. et al., *Protein Cell.* 2018 January; 9(1):33-46; Polakis P. et al., *Pharmacol Rev.* 2016 January; 68(1):3-19). Examples of methods that may be used to perform conjugation include, but are not limited to, chemical conjugation and enzymatic conjugation.

Chemical conjugation may utilize, for example, but is not limited to, lysine amide coupling, cysteine coupling, and/or non-natural amino acid incorporation by genetic engineering. Enzymatic conjugation may utilize, for example, but is not limited to, transpeptidation using sortase, transpeptidation using microbial transglutaminase, and/or N-Glycan engineering.

In certain aspects, one or more of cleavable linkers may be used for conjugation. The cleavable linker may enable cleavage of the drug upon responding to, for example, but not limited to, an environmental difference between the extracellular and intracellular environments (pH, redox potential, etc.) or by specific lysosomal enzymes.

Examples of the cleavable linker include, but are not limited to, hydrazone linkers, peptide linkers including cathepsin B-responsive linkers, such as valine-citrulline (vc) linker, disulfide linkers such as N-succinimidyl-4-(2-pyridyldithio) (SPP) linker or N-succinimidyl-4-(2-pyridyl-dithio)butanoate (SPDB) linker, and pyrophosphate diester linkers.

Alternatively or simultaneously, one or more of non-cleavable linkers may be used. Examples of non-cleavable linkers include thioether linkers, such as N-succinimidyl 4-(N-maleimidomethyl) cyclohexane-1-carboxylate (SMCC), and maleimidocaproyl (mc) linkers. Generally, non-cleavable linkers are more resistant to proteolytic degradation and more stable compared to cleavable linkers.

E. Chimeric Antigen Receptor Comprising Anti-CoV-S Antigen-Binding Antibody Fragment In some embodiments, a compound specific to CoV-S according to the present disclosure may be a chimeric antigen receptor (CAR). In particular, the CARs of the present disclosure comprise an antigen binding (AB) domain that binds to CoV-S, a transmembrane (TM) domain, and an intracellular signaling (ICS) domain. In some embodiments, a CAR may comprise a hinge that joins the AB domain and said TM domain. In some embodiments, the CAR may comprise one or more costimulatory (CS) domains.

AB Domain

A CAR according to the disclosure will comprise an antigen-binding (AB) domain which binds to COV-S. In some embodiments, the AB domain of the CAR may comprise any of the anti-COV-S antigen-binding antibody fragments disclosed herein.

In some embodiments, the AB domain of the CAR may comprise any of the antigen-binding domain of any of the anti-COV-S antibodies disclosed herein.

In some embodiments, the AB domain of the CAR may comprise any of the anti-COV-S antibodies, anti-COV-S antigen-binding antibody fragments, anti-COV-S multi-specific Abs, anti-COV-S multi-specific antigen-binding antibody fragments, and anti-COV-S ADCs disclosed herein, or the ABD thereof.

In some embodiments, the AB domain of the CAR may comprise an anti-COV-S scFv.

In some embodiments, the AB domain may comprise an amino acid sequence at least 80%, at least 85%, at least 90%, at least 91%, at least 92%, at least 93%, at least 94%, at least 95%, at least 96%, at least 97%, at least 98%, at least 99%, or 100% identical to an scFv comprising the VH and VL of any one of antibodies as described herein and in FIGS. 1, 2 and 36.

In some aspects, the AB domain may compete for binding to COV-S with any one of antibodies as described herein and in FIGS. 1, 2 and 36.

Hinge

In some embodiments, the CAR may comprise a hinge sequence between the AB domain and the TM domain. One of the ordinary skill in the art will appreciate that a hinge sequence is a short sequence of amino acids that facilitates flexibility (see, e.g. Woof J. M. et al., *Nat. Rev. Immunol.*, 4(2): 89-99 (2004)). The hinge sequence can be any suitable sequence derived or obtained from any suitable molecule.

In some embodiments, the length of the hinge sequence may be optimized based on the desired length of the extracellular portion of the CAR, which may be based on the location of the epitope within the target molecule. For example, if the epitope is in the membrane proximal region within the target molecule, longer hinges may be optimal.

In some embodiments, the hinge may be derived from or include at least a portion of an immunoglobulin Fc region, for example, an IgG1 Fc region, an IgG2 Fc region, an IgG3 Fc region, an IgG4 Fc region, an IgE Fc region, an IgM Fc region, or an IgA Fc region. In certain embodiments, the hinge includes at least a portion of an IgG1, an IgG2, an IgG3, an IgG4, an IgE, an IgM, or an IgA immunoglobulin Fc region that falls within its CH2 and CH3 domains In some embodiments, the hinge may also include at least a portion of a corresponding immunoglobulin hinge region. In some embodiments, the hinge is derived from or includes at least a portion of a modified immunoglobulin Fc region, for example, a modified IgG1 Fc region, a modified IgG2 Fc region, a modified IgG3 Fc region, a modified IgG4 Fc region, a modified IgE Fc region, a modified IgM Fc region, or a modified IgA Fc region. The modified immunoglobulin Fc region may have one or more mutations (e.g., point mutations, insertions, deletions, duplications) resulting in one or more amino acid substitutions, modifications, or deletions that cause impaired binding of the hinge to an Fc receptor (FcR). In some aspects, the modified immunoglobulin Fc region may be designed with one or more mutations which result in one or more amino acid substitutions, modifications, or deletions that cause impaired binding of the hinge to one or more FcR including, but not limited to, FcγRI, FcγR2A, FcγR2B1, Fcγ2B2, Fcγ 3A, Fcγ 3B, FcεRI, FcεR2, FcαRI, Fcα/μR, or FcRn.

In some aspects, a portion of the immunoglobulin constant region may serve as a hinge between the AB domain, for example scFv or nanobody, and the TM domain. The hinge can be of a length that provides for increased responsiveness of the CAR-expressing cell following antigen binding, as compared to in the absence of the hinge. In some examples, the hinge is at or about 12 amino acids in length or is no more than 12 amino acids in length. Exemplary hinges include those having at least about 10 to 229 amino acids, about 10 to 200 amino acids, about 10 to 175 amino acids, about 10 to 150 amino acids, about 10 to 125 amino acids, about 10 to 100 amino acids, about 10 to 75 amino acids, about 10 to 50 amino acids, about 10 to 40 amino acids, about 10 to 30 amino acids, about 10 to 20 amino acids, or about 10 to 15 amino acids, and including any integer between the endpoints of any of the listed ranges. In some embodiments, a hinge has about 12 amino acids or less, about 119 amino acids or less, or about 229 amino acids or less. Exemplary hinges include a CD28 hinge, IgG4 hinge alone, IgG4 hinge linked to CH2 and CH3 domains, or IgG4 hinge linked to the CH3 domain. Exemplary hinges include, but are not limited to, those described in Hudecek M. et al. (2013) *Clin. Cancer Res.*, 19:3153, international patent application publication number WO2014031687, U.S. Pat. No. 8,822,647 or published App. No. US2014/0271635.

Known hinge sequences include those derived from CD8 a molecule or a CD28 molecule.

Transmembrane (TM) Domain

With respect to the TM domain, the CAR can be designed to comprise a TM domain that is fused to the AB domain of the CAR. A hinge sequence may be inserted between the AB domain and the TM domain. TM domains may be derived from a natural or from synthetic sources. Where the source is natural, the domain may be derived from any membrane-bound or transmembrane protein. Typically, a TM domain denotes a single transmembrane a helix of a transmembrane protein, also known as an integral protein. TM domains e.g., may be derived from (i.e. comprise at least the transmembrane region(s) of) CD28, CD3 ε, CD4, CD5, CD8, CD9, CD16, CD22, CD33, CD37, CD45, CD64, CD80, CD86, CD134, CD137, CD154, TCR a, TCR (3, or CD3 zeta and/or TM domains containing functional variants thereof such as those retaining a substantial portion of the structural, e.g., transmembrane, properties thereof.

Alternatively, the TM domain may be synthetic, in which case the TM domain will comprise predominantly hydrophobic residues such as leucine and valine. Preferably a triplet of phenylalanine, tryptophan and valine will be found at each end of a synthetic TM domain. A TM domain is generally thermodynamically stable in a membrane. It may be a single a helix, a transmembrane β barrel, a β-helix of gramicidin A, or any other structure. Transmembrane helices are usually about 20 amino acids in length.

A well-used TM domain comprises the TM region of CD28, e.g., human CD28. Often, a short oligo- or polypeptide spacer, e.g., between 2 and 10 amino acids in length is used to form the linkage between the TM domain and the ICS domain(s) of the CAR.

Intracellular Signaling (ICS) Domain and Costimulatory (CS) Domain

The ICS domain or the cytoplasmic domain of a CAR generally triggers or elicits activation of at least one of the normal effector functions of the cell in which the CAR has been placed. The term "effector function" refers to a specialized function of a cell. Effector function of a T cell, for example, may be cytolytic activity or helper activity including the secretion of cytokines. Thus, the term "intracellular signaling domain" or "ICS domain" refers to the portion of a protein which transduces the effector function signal and directs the cell to perform a specialized function. While usually the entire ICS domain can be employed, in many cases it is not necessary to use the entire chain. To the extent that a truncated portion of the intracellular signaling domain is used, such truncated portion may be used in place of the intact chain as long as it transduces the effector function signal. The term "intracellular signaling domain" or "ICS domain" is thus meant to include any truncated portion of the ICS domain sufficient to transduce the effector function signal.

Examples of known ICS domains include the cytoplasmic sequences of the T cell receptor (TCR) and co-receptors that act in concert to initiate signal transduction following antigen receptor engagement, as well as any derivative or variant of these sequences and any synthetic sequence that has the same functional capability.

Signals generated through one ICS domain alone may be insufficient for full activation of a cell, and a secondary or costimulatory signal may also be required. In such cases, a costimulatory domain (CS domain) may be included in the cytoplasmic portion of a CAR. A CS domain is a domain that transduces such a secondary or costimulatory signal. In some instances, a CAR of the present disclosure may comprise two or more CS domains. The CS domain(s) may be placed upstream of the ICS domain or downstream of the ICS domain.

T cell activation can be mediated by two distinct classes of cytoplasmic signaling sequence: those that initiate antigen-dependent primary activation through the TCR (primary cytoplasmic signaling sequences) and those that act in an antigen-independent manner to provide a secondary or costimulatory signal (secondary cytoplasmic signaling sequences). Primary cytoplasmic signaling sequences regulate primary activation of the TCR complex either in a stimulatory way, or in an inhibitory way. Primary cytoplasmic signaling sequences that act in a stimulatory manner may contain signaling motifs which are known as immunoreceptor tyrosine-based activation motifs or ITAMs. Such a cytoplasmic signaling sequence may be contained in the ICS or the CS domain of a CAR.

Examples of ITAM-containing primary cytoplasmic signaling sequences include those derived from an ICS domain of a lymphocyte receptor chain, a TCR/CD3 complex protein, an Fc receptor subunit, an IL-2 receptor subunit, CDKζFcRγ, FcRβ, CD3γ, CD3δ, CD3ε, CD5, CD22, CD66d, CD79a, CD79b, CD278 (ICOS), Fcε RI, DAP10, and DAP12. A well-used ICS domain comprises a cytoplasmic signaling sequence derived from CD3 zeta. In some instances, the CD3ζICS domain may be combined with one or more of other cytoplasmic domain(s). For example, the cytoplasmic domain of the CAR can comprise a CD3 ζICS domain and a CS domain wherein a CS region refers to a portion of the CAR comprising the intracellular domain of a costimulatory molecule. A costimulatory molecule is a cell surface molecule other than an antigen receptor or their ligands that is required for an efficient response of lymphocytes to an antigen.

Examples of co-stimulatory molecules include an MHC class I molecule, TNF receptor proteins, Immunoglobulin-like proteins, cytokine receptors, integrins, signaling lymphocytic activation molecules (SLAM proteins), activating NK cell receptors, a Toll ligand receptor, B7-H3, BAFFR, BTLA, BLAME (SLAMF8), CD2, CD4, CD5, CD7, CD8α, CD8β, CD11a, LFA-1 (CD11a/CD18), CD11b, CD11c, CD11d, CD18, CD19, CD19a, CD27, CD28, CD29, CD30, CD40, CD49a, CD49D, CD49f, CD69, CD84, CD96 (Tactile), CD100 (SEMA4D), CD103, CRTAM, OX40 (CD134), 4-1BB (CD137), SLAM (SLAMF1, CD150, IPO-3), CD160 (BY55), SELPLG (CD162), DNAM1 (CD226), Ly9 (CD229), SLAMF4 (CD244, 2B4), ICOS (CD278), CEACAM1, CDS, CRTAM, DAP10, GADS, GITR, HVEM (LIGHTR), IA4, ICAM-1, IL2R β, IL2R γ, IL7R α, ITGA4, ITGA6, ITGAD, ITGAE, ITGAL, ITGAM, ITGAX, ITGB1, ITGB2, ITGB7, KIRDS2, LAT, LFA-1, LIGHT, LTBR, NKG2C, NKG2D, NKp30, NKp44, NKp46, NKp80 (KLRF1), PAG/Cbp, PD-1, PSGL1, SLAMF6 (NTB-A, Ly108), SLAMF7, SLP-76, TNFR2, TRANCE/RANKL, VLA1, VLA-6, a ligand that specifically binds with CD83, and the like. The ICS domain and the CS domain(s) of the CAR may be linked to each other in a random or specified order, optionally via a short oligo- or polypeptide linker, e.g., between 2 and 10 amino acids in length.

Exemplary CAR Constructs

A CAR construct may comprise the following format: "AB domain-hinge-TM domain-CS domain-ICS domain."

CARs may comprise an amino acid sequence at least 80%, at least 85%, at least 90%, at least 91%, at least 92%, at least 93%, at least 94%, at least 95%, at least 96%, at least 97%, at least 98%, at least 99%, or 100% identical to any of the exemplary constructs below. In the exemplary constructs below, the "anti-CoV-S scFv" may be an scFv generated by linking the VH and VL (in the order of VH-linker-VL or VL-linker-VH) of any one of anti-CoV-S antibodies as described herein and in FIGS. 1, 2 and 36.

In some embodiments, a leader sequence (LS) may be placed upstream of the polynucleotide sequences encoding the CAR. The leader sequence facilitates the expression of the CAR on the cell surface.

Further Modification

CARs according to the present disclosure, nucleotide sequences encoding the same, vectors encoding the same, and cells comprising nucleotide sequences encoding said CARs may be further modified, engineered, optimized, or appended in order to provide or select for various features. These features may include, but are not limited to, efficacy, persistence, target specificity, reduced immunogenicity, multi-targeting, enhanced immune response, expansion, growth, reduced off-target effect, reduced subject toxicity, improved target cytotoxicity, improved attraction of disease alleviating immune cells, detection, selection, targeting, and the like. For example, the cells may be engineered to express another CAR, or to have a suicide mechanism, and may be modified to remove or modify expression of an endogenous receptor or molecule such as a TCR and/or MHC molecule.

In some embodiments, the vector or nucleic acid sequence encoding the CAR further encodes other genes. The vector or nucleic acid sequence may be constructed to allow for the co-expression of multiple genes using a multitude of techniques including co-transfection of two or more plasmids, the use of multiple or bidirectional promoters, or the creation of bicistronic or multicistronic vectors. The construction of multicistronic vectors may include the encoding of IRES elements or 2A peptides, such as T2A, P2A, E2A, or F2A (for example, see Kim, J. H., et al., "High cleavage efficiency of a 2A peptide derived from porcine teschovirus-1 in human cell lines, zebrafish and mice", *PLoS One.* 2011; 6(4)). The CAR expressing cell may further comprise a disruption to one or more endogenous genes.

Efficacy

The CARs of the present disclosure and cells expressing these CARs may be further modified to improve efficacy against cells expressing the target molecule. The cells may be cells expressing COV-S. The cells expressing COV-S may be cancer cells, vascular cells, or any other target disease-associated cells. In some embodiments, the improved efficacy may be measured by increased cytotoxicity against cells expressing the target molecule, for example cytotoxicity against cancer cells. In some embodiments, the improved efficacy may also be measured by increased production of cytotoxic mediators such as, but not limited to, IFN γ, perforin, and granzyme B. In some embodiments, the improved efficacy may be shown by reduction in the signature cytokines of the diseases, or alleviated symptoms of the disease when the CAR expressing cells are administered to a subject. Other cytokines that may be reduced include TGF-beta, IL-6, IL-4, IL-10, and/or IL-13. the improved efficacy may be shown by COV-S-specific immune cell responses, such as T cell cytotoxicity. In case of cancer, improved efficacy may be shown by better tumor cytotoxicity, better infiltration into the tumor, reduction of immunosuppressive mediators, reduction in weight decrease, reduction in ascites, reduction in tumor burden, and/or increased lifespan. In case of autoimmune diseases, reduced responsiveness of autoreactive cells or decrease in autoreactive T cells, B cells, or Abs may represent improved efficacy. In some embodiments, gene expression profiles may be also investigated to evaluate the efficacy of the CAR.

In one aspect, the CAR expressing cells are further modified to evade or neutralize the activity of immunosuppressive mediators, including, but not limited to prostaglandin E2 (PGE2) and adenosine. In some embodiments, this evasion or neutralization is direct. In other embodiments, this evasion or neutralization is mediated via the inhibition of protein kinase A (PKA) with one or more binding partners, for example ezrin. In a specific embodiment, the CAR-expressing cells further express the peptide "regulatory subunit I anchoring disruptor" (RIAD). RIAD is thought to inhibit the association of protein kinase A (PKA) with ezrin, which thus prevents PKA's inhibition of TCR activation (Newick K. et al. *Cancer Immunol Res.* 2016 June; 4(6):541-51).

In some embodiments, the CAR expressing cells may induce a broad immune response, consistent with epitope spreading.

In some embodiments, the CAR expressing cells further comprise a homing mechanism. For example, the cell may transgenically express one or more stimulatory chemokines or cytokines or receptors thereof. In particular embodiments, the cells are genetically modified to express one or more stimulatory cytokines. In certain embodiments, one or more homing mechanisms are used to assist the inventive cells to accumulate more effectively to the disease site. In some embodiments, the CAR expressing cells are further modified to release inducible cytokines upon CAR activation, e.g., to attract or activate innate immune cells to a targeted cell (so-called fourth generation CARs or TRUCKS). In some embodiments, CARs may co-express homing molecules, e.g., CCR4 or CCR2b, to increase trafficking to the disease site.

Controlling CAR Expression

In some instances, it may be advantageous to regulate the activity of the CAR or CAR expressing cells CAR. For example, inducing apoptosis using, e.g., a caspase fused to a dimerization domain (see, e.g., Di et al., *N Engl. J. Med.* 2011 Nov. 3; 365(18):1673-1683), can be used as a safety switch in the CAR therapy of the instant disclosure. In another example, CAR-expressing cells can also express an inducible Caspase-9 (iCaspase-9) molecule that, upon administration of a dimerizer drug (e.g., rimiducid (also called AP1903 (Bellicum Pharmaceuticals) or AP20187 (Ariad)) leads to activation of the Caspase-9 and apoptosis of the cells. The iCaspase-9 molecule contains a chemical inducer of dimerization (CID) binding domain that mediates dimerization in the presence of a CID. This results in inducible and selective depletion of CAR-expressing cells. In some cases, the iCaspase-9 molecule is encoded by a nucleic acid molecule separate from the CAR-encoding vector(s). In some cases, the iCaspase-9 molecule is encoded by the same nucleic acid molecule as the CAR-encoding vector. The iCaspase-9 can provide a safety switch to avoid any toxicity of CAR-expressing cells. See, e.g., Song et al.

*Cancer Gene Ther.* 2008; 15(10):667-75; Clinical Trial Id. No. NCT02107963; and Di et al. *N. Engl. J. Med.* 2011; 365:1673-83.

Alternative strategies for regulating the CAR therapy include utilizing small molecules or antibodies that deactivate or turn off CAR activity, e.g., by deleting CAR-expressing cells, e.g., by inducing antibody dependent cell-mediated cytotoxicity (ADCC). For example, CAR-expressing cells described herein may also express an antigen that is recognized by molecules capable of inducing cell death, e.g., ADCC or compliment-induced cell death. For example, CAR expressing cells described herein may also express a receptor capable of being targeted by an antibody or antibody fragment. Examples of such receptors include EpCAM, VEGFR, integrins (e.g., integrins $\alpha v\beta 3$, $\alpha 4$, $\alpha I3/4\beta 3$, $\alpha 4\beta 7$, $\alpha 5\beta 1$, $\alpha v\beta 3$, $\alpha v$), members of the TNF receptor superfamily (e.g., TRAIL-R1, TRAIL-R2), PDGF Receptor, interferon receptor, folate receptor, GPNMB, ICAM-1, HLA-DR, CEA, CA-125, MUC1, TAG-72, IL-6 receptor, 5T4, GD2, GD3, CD2, CD3, CD4, CD5, CD11, CD11a/LFA-1, CD15, CD18/ITGB2, CD19, CD20, CD22, CD23/IgE Receptor, CD25, CD28, CD30, CD33, CD38, CD40, CD41, CD44, CD51, CD52, CD62L, CD74, CD80, CD125, CD147/basigin, CD152/CTLA-4, CD154/CD40L, CD195/CCR5, CD319/SLAMF7, and EGFR, and truncated versions thereof (e.g., versions preserving one or more extracellular epitopes but lacking one or more regions within the cytoplasmic domain) For example, CAR-expressing cells described herein may also express a truncated epidermal growth factor receptor (EGFR) which lacks signaling capacity but retains the epitope that is recognized by molecules capable of inducing ADCC, e.g., cetuximab (ERBITUX®), such that administration of cetuximab induces ADCC and subsequent depletion of the CAR-expressing cells (see, e.g., WO2011/056894, and Jonnalagadda et al., "*Gene Ther.* 2013; 20(8)853 860).

In some embodiments, the CAR cell comprises a polynucleotide encoding a suicide polypeptide, such as for example RQR8. See, e.g., WO2013153391A, which is hereby incorporated by reference in its entirety. In CAR cells comprising the polynucleotide, the suicide polypeptide may be expressed at the surface of a CAR cell. The suicide polypeptide may also comprise a signal peptide at the amino terminus. Another strategy includes expressing a highly compact marker/suicide gene that combines target epitopes from both CD32 and CD20 antigens in the CAR-expressing cells described herein, which binds rituximab, resulting in selective depletion of the CAR-expressing cells, e.g., by ADCC (see, e.g., Philip et al., *Blood* 2014; 124(8)1277-1287). Other methods for depleting CAR-expressing cells include administration of CAMPATH®, a monoclonal anti-CD52 antibody that selectively binds and targets mature lymphocytes, e.g., CAR-expressing cells, for destruction, e.g., by inducing ADCC. In other embodiments, the CAR-expressing cell can be selectively targeted using a CAR ligand, e.g., an anti-idiotypic antibody. In some embodiments, the anti-idiotypic antibody can cause effector cell activity, e.g., ADCC or ADC activities, thereby reducing the number of CAR-expressing cells. In other embodiments, the CAR ligand, e.g., the anti-idiotypic antibody, can be coupled to an agent that induces cell killing, e.g., a toxin, thereby reducing the number of CAR-expressing cells. Alternatively, the CAR molecules themselves can be configured such that the activity can be regulated, e.g., turned on and off, as described below.

In some embodiments, a regulatable CAR (RCAR) where the CAR activity can be controlled is desirable to optimize the safety and efficacy of a CAR therapy. In some embodiments, a RCAR comprises a set of polypeptides, typically two in the simplest embodiments, in which the components of a standard CAR described herein, e.g., an AB domain and an ICS domain, are partitioned on separate polypeptides or members. In some embodiments, the set of polypeptides include a dimerization switch that, upon the presence of a dimerization molecule, can couple the polypeptides to one another, e.g., can couple an AB domain to an ICS domain. Additional description and exemplary configurations of such regulatable CARs are provided herein and in International Publication No. WO 2015/090229, hereby incorporated by reference in its entirety.

In an aspect, an RCAR comprises two polypeptides or members: 1) an intracellular signaling member comprising an ICS domain, e.g., a primary ICS domain described herein, and a first switch domain; 2) an antigen binding member comprising an AB domain, e.g., that specifically binds a target molecule described herein, as described herein and a second switch domain. Optionally, the RCAR comprises a TM domain described herein. In an embodiment, a TM domain can be disposed on the intracellular signaling member, on the antigen binding member, or on both. Unless otherwise indicated, when members or elements of an RCAR are described herein, the order can be as provided, but other orders are included as well. In other words, in an embodiment, the order is as set out in the text, but in other embodiments, the order can be different. E.g., the order of elements on one side of a transmembrane region can be different from the example, e.g., the placement of a switch domain relative to an ICS domain can be different, e.g., reversed.

In some embodiments, the CAR expressing immune cell may only transiently express a CAR. For example, the cells may be transduced with mRNA comprising a nucleic acid sequence encoding an inventive CAR. In this vein, the present disclosure also includes an RNA construct that can be directly transfected into a cell. A method for generating mRNA for use in transfection involves in vitro transcription (IVT) of a template with specially designed primers, followed by polyA addition, to produce a construct containing 3' and 5' untranslated sequences ("UTRs"), a 5' cap and/or Internal Ribosome Entry Site (IRES), the nucleic acid to be expressed, and a polyA tail, typically 50-2000 bases in length (SEQ ID NO: 23193). RNA so produced can efficiently transfect different kinds of cells. In one embodiment, the template includes sequences for the CAR. In an embodiment, an RNA CAR vector is transduced into a cell by electroporation.

Target Specificity

The CAR expressing cells may further comprise one or more CARs, in addition to the first CAR. These additional CARs may or may not be specific for the target molecule of the first CAR. In some embodiments, the one or more additional CARs may act as inhibitory or activating CARs. In some aspects, the CAR of some embodiments is the stimulatory or activating CAR; in other aspects, it is the costimulatory CAR. In some embodiments, the cells further include inhibitory CARs (iCARs, see Fedorov et al., *Sci. Transl. Medicine,* 2013 December; 5(215): 215ra172), such as a CAR recognizing an antigen other than the target molecule of the first CAR, whereby an activating signal delivered through the first CAR is diminished or inhibited by binding of the inhibitory CAR to its ligand, e.g., to reduce off-target effects.

In some embodiments, the AB domain of the CAR is or is part of an immunoconjugate, in which the AB domain is conjugated to one or more heterologous molecule(s), such as, but not limited to, a cytotoxic agent, an imaging agent, a detectable moiety, a multimerization domain, or other heterologous molecule. Cytotoxic agents include, but are not limited to, radioactive isotopes (e.g., At211, I131, I125, Y90, Re186, Re188, Sm153, Bi212, P32, Pb212 and radioactive isotopes of Lu); chemotherapeutic agents; growth inhibitory agents; enzymes and fragments thereof such as nucleolytic enzymes; antibiotics; toxins such as small molecule toxins or enzymatically active toxins. In some embodiments, the AB domain is conjugated to one or more cytotoxic agents, such as chemotherapeutic agents or drugs, growth inhibitory agents, toxins (e.g., protein toxins, enzymatically active toxins of bacterial, fungal, plant, or animal origin, or fragments thereof), or radioactive isotopes.

In some embodiments, to enhance persistence, the cells may be further modified to overexpress pro-survival signals, reverse anti-survival signals, overexpress Bcl-xL, overexpress hTERT, lack Fas, or express a TGF-β dominant negative receptor. Persistence may also be facilitated by the administration of cytokines, e.g., IL-2, IL-7, and IL-15.

F. B-Cell Screening and Isolation

In one embodiment, the present disclosure contemplates the preparation and isolation of a clonal population of antigen-specific B-cells that may be used for isolating at least one CoV-S antigen-specific cell, which can be used to produce a monoclonal antibody against CoV-S, which is specific to a desired CoV-S antigen, or a nucleic acid sequence corresponding to such an antibody. Methods of preparing and isolating said clonal population of antigen-specific B-cells are taught, for example, in U.S. Patent Publication No. US2007/0269868 to Carvalho-Jensen et al., the disclosure of which is herein incorporated by reference in its entirety. Methods of preparing and isolating said clonal population of antigen-specific B-cells are also taught herein in the examples. Methods of "enriching" a cell population by size or density are known in the art. See, e.g., U.S. Pat. No. 5,627,052. These steps can be used in addition to enriching the cell population by antigen-specificity.

G. Methods of Producing Antibodies and Fragments Thereof

In another embodiment, the present disclosure contemplates methods for producing anti-CoV-S antibodies and fragments thereof. Methods of producing antibodies are well known to those of ordinary skill in the art. For example, methods of producing chimeric antibodies are now well known in the art (See, for example, U.S. Pat. No. 4,816,567 to Cabilly et al.; Morrison et al., *Proc. Natl. Acad. Sci. U.S.A.*, 81:8651-55 (1984); Neuberger et al., *Nature,* 314: 268-270 (1985); Boulianne, G. L. et al., *Nature,* 312:643-46 (1984), the disclosures of each of which are herein incorporated by reference in their entireties).

As mentioned above, methods of producing humanized antibodies are now well known in the art (See, for example, U.S. Pat. Nos. 5,530,101, 5,585,089, 5,693,762, and 6,180,370 to Queen et al; U.S. Pat. Nos. 5,225,539 and 6,548,640 to Winter; U.S. Pat. Nos. 6,054,297, 6,407,213 and 6,639,055 to Carter et al; U.S. Pat. No. 6,632,927 to Adair; Jones, P. T. et al., *Nature,* 321:522-525 (1986); Reichmann, L et al., *Nature,* 332:323-327 (1988); Verhoeyen, M. et al., *Science,* 239:1534 36 (1988), the disclosures of each of which are herein incorporated by reference in their entireties).

Antibody polypeptides of the disclosure having CoV-S binding specificity may also be produced by constructing, using conventional techniques well known to those of ordinary skill in the art, an expression vector containing a promoter (optionally as a component of a eukaryotic or prokaryotic operon) and a DNA sequence encoding an antibody heavy chain in which the DNA sequence encoding the CDRs required for antibody specificity is derived from a non-human cell source, e.g., a rabbit or rodent B-cell source, while the DNA sequence encoding the remaining parts of the antibody chain is derived from a human cell source.

A second expression vector is produced using the same conventional means well known to those of ordinary skill in the art, said expression vector containing a promoter (optionally as a component of a eukaryotic or prokaryotic operon) and a DNA sequence encoding an antibody light chain in which the DNA sequence encoding the CDRs required for antibody specificity is derived from a non-human cell source, e.g., a rabbit or rodent B-cell source, while the DNA sequence encoding the remaining parts of the antibody chain is derived from a human cell source.

The expression vectors are transfected into a host cell by convention techniques well known to those of ordinary skill in the art to produce a transfected host cell, said transfected host cell cultured by conventional techniques well known to those of ordinary skill in the art to produce said antibody polypeptides.

The host cell may be co-transfected with the two expression vectors described above, the first expression vector containing DNA encoding a promoter (optionally as a component of a eukaryotic or prokaryotic operon) and a light chain-derived polypeptide and the second vector containing DNA encoding a promoter (optionally as a component of a eukaryotic or prokaryotic operon) and a heavy chain-derived polypeptide. The two vectors contain different selectable markers, but preferably achieve substantially equal expression of the heavy and light chain polypeptides. Alternatively, a single vector may be used, the vector including DNA encoding both the heavy and light chain polypeptides. The coding sequences for the heavy and light chains may comprise cDNA, genomic DNA, or both.

The host cells used to express the antibody polypeptides may be either a bacterial cell such as *E. coli*, or a eukaryotic cell such as *P. pastoris*. In one embodiment, a mammalian cell of a well-defined type for this purpose, such as a myeloma cell, a CHO cell line, a NSO cell line, or a HEK293 cell line may be used.

The general methods by which the vectors may be constructed, transfection methods required to produce the host cell and culturing methods required to produce the antibody polypeptides from said host cells all include conventional techniques. Although preferably the cell line used to produce the antibody is a mammalian cell line, any other suitable cell line, such as a bacterial cell line such as an *E. coli*-derived bacterial strain, or a yeast cell line, may alternatively be used.

Similarly, once produced the antibody polypeptides may be purified according to standard procedures in the art, such as for example cross-flow filtration, ammonium sulphate precipitation, affinity column chromatography, hydrophobic interaction chromatography ("HIC"), and the like.

The antibody polypeptides described herein may also be used for the design and synthesis of either peptide or non-peptide mimetics that would be useful for the same therapeutic applications as the antibody polypeptides of the disclosure (See, for example, Saragobi et al., *Science*, 253: 792-795 (1991), the contents of which are herein incorporated by reference in its entirety).

In another embodiment, the present disclosure contemplates methods for humanizing antibody heavy and light chains which bind to CoV-S. Exemplary methods for humanizing antibody heavy and light chains that may be applied to anti-CoV-S antibodies are identified herein and are conventional in the art.

H. Screening Assays

The screening assays described here may be used to identify high affinity anti-CoV-S Abs which may be useful in the treatment of diseases and disorders associated with CoV-S in subjects exhibiting symptoms of a CoV-S associated disease or disorder.

In some embodiments, the antibody is used as a diagnostic tool. The antibody can be used to assay the amount of CoV-S present in a sample and/or subject. As will be appreciated by one of skill in the art, such antibodies need not be neutralizing antibodies. In some embodiments, the diagnostic antibody is not a neutralizing antibody. In some embodiments, the diagnostic antibody binds to a different epitope than the neutralizing antibody binds to. In some embodiments, the two antibodies do not compete with one another.

In some embodiments, the antibodies disclosed herein are used or provided in an assay kit and/or method for the detection of CoV-S in mammalian tissues or cells in order to screen/diagnose for a disease or disorder associated with changes in levels of CoV-S. The kit comprises an antibody that binds CoV-S and means for indicating the binding of the antibody with CoV-S, if present, and optionally CoV-S protein levels. Various means for indicating the presence of an antibody can be used. For example, fluorophores, other molecular probes, or enzymes can be linked to the antibody and the presence of the antibody can be observed in a variety of ways. The method for screening for such disorders can involve the use of the kit, or simply the use of one of the disclosed antibodies and the determination of whether the antibody binds to CoV-S in a sample. As will be appreciated by one of skill in the art, high or elevated levels of CoV-S will result in larger amounts of the antibody binding to CoV-S in the sample. Thus, degree of antibody binding can be used to determine how much CoV-S is in a sample. Subjects or samples with an amount of CoV-S that is greater than a predetermined amount (e.g., an amount or range that a person without a CoV-S-related disorder would have) can be characterized as having a CoV-S-mediated disorder.

The present disclosure further provides for a kit for detecting binding of an anti-CoV-S antibody of the disclosure to CoV-S. In particular, the kit may be used to detect the presence of CoV-S specifically reactive with an anti-CoV-S antibody or an immunoreactive fragment thereof. The kit may also include an antibody bound to a substrate, a secondary antibody reactive with the antigen and a reagent for detecting a reaction of the secondary antibody with the antigen. Such a kit may be an ELISA kit and can comprise the substrate, primary and secondary antibodies when appropriate, and any other necessary reagents such as detectable moieties, enzyme substrates, and color reagents, for example as described herein. The diagnostic kit may also be in the form of an immunoblot kit. The diagnostic kit may also be in the form of a chemiluminescent kit (Meso Scale Discovery, Gaithersburg, Md.). The diagnostic kit may also be a lanthanide-based detection kit (PerkinElmer, San Jose, Calif.).

A skilled clinician would understand that a biological sample includes, but is not limited to, sera, plasma, urine, fecal sample, saliva, mucous, pleural fluid, synovial fluid, and spinal fluid.

I. Methods of Ameliorating or Reducing Symptoms of or Treating, or Preventing, Diseases and Disorders Associated with CoV In another embodiment, anti-CoV-S antibodies described herein, or antigen-binding fragments thereof, are useful for ameliorating or reducing the symptoms of, or treating, or preventing, diseases and disorders associated with CoV-S. Anti-CoV-S antibodies described herein, or antigen-binding fragments thereof, as well as combinations, can also be administered in a therapeutically effective amount to patients in need of treatment of diseases and disorders associated with CoV-S in the form of a pharmaceutical composition as described in greater detail below.

Symptoms of CoV infection may include fever, cough, runny nose, congestion, sore throat, bronchitis, pneumonia, shortness of breath, chest pain, headache, muscle ache, chills, fatigue, conjunctivitis, diarrhea, loss of smell, and loss of taste. Complications and/or diseases/disorders associated with coronavirus infection may include, for example, bronchitis, pneumonia, respiratory failure, acute respiratory failure, organ failure, multi-organ system failure, pediatric inflammatory multisystem syndrome, acute respiratory distress syndrome (a severe lung condition that causes low oxygen in the blood and organs), blood clots, cardiac conditions, myocardial injury, myocarditis, heart failure, cardiac arrest, acute myocardial infarction, dysrhythmias, venous thromboembolism, post-intensive care syndrome, shock, anaphylactic shock, cytokine release syndrome, septic shock, disseminated intravascular coagulation, ischemic stroke, intracerebral hemorrhage, microangiopathic thrombosis, psychosis, seizure, nonconvulsive status epilepticus, traumatic brain injury, stroke, anoxic brain injury, encephalitis, posterior reversible leukoencephalopathy, necrotizing encephalopathy, post-infectious encephalitis, autoimmune mediated encephalitis, acute disseminated encephalomyelitis, acute kidney injury, acute liver injury, pancreatic injury, immune thrombocytopenia, subacute thyroiditis, gastrointestinal complications, aspergillosis, increased susceptibility to infection with another virus or bacteria, and/or pregnancy-related complications. Certain diseases and conditions, such as high blood pressure, type 1 diabetes, liver disease, overweight, chronic lung diseases including cystic fibrosis, pulmonary fibrosis, and asthma, compromised immune system due to transplant, use of an immunosuppressant, or HIV infection, and brain and nervous system condition, may increase the risk of CoV infection-associated complications and diseases.

Also, the subject anti-CoV-S antibodies and antigen-binding fragments may be used alone or in conjunction with other active agents, e.g., opioids and non-opioid analgesics such as NSAIDs to elicit analgesia. In some embodiments, aspirin and/or acetaminophen may be taken in conjunction with the subject anti-CoV-S antibody or antigen-binding fragment. Aspirin is another type of non-steroidal anti-inflammatory compound.

The subject antibodies potentially optionally may be combined with one or more of the following: (i) an antiviral drug, optionally, remdesivir, favipiravir, darunavir, nelfinavir, saquinavir, lopinavir, or ritonavir; (ii) an antihelminth drug, optionally ivermectin; (iii) an antiparasitic drug, optionally hydroxychloroquine, chloroquine, or atovaquone; (iv) antibacterial vaccine, optionally the tuberculosis vaccine BCG; or (v) an anti-inflammatory drug, optionally a steroid such as ciclesonide, a TNF inhibitor (e.g., adalimumab), a TNF receptor inhibitor (e.g., etanercept), an IL-6 inhibitor (e.g., clazakizumab), an IL-6 receptor inhibitor (e.g., toclizumab), or metamizole; (vi) an antihistamine drug, optionally bepotastine; (vii) an ACE inhibitor, which is optionally moexipril; or (viii) a drug that inhibits priming of CoV-S, optionally a serine protease inhibitor, further optionally nafamostat. in order to increase or enhance pain management. This may allow for such analgesic compounds to be administered for longer duration or at reduced dosages thereby potentially alleviating adverse side effects associated therewith.

The subject to which the pharmaceutical formulation is administered can be, e.g., any human or non-human animal needing such treatment, prevention and/or amelioration, or who would otherwise benefit from the inhibition or attenuation of CoV-S-mediated activity. For example, the subject can be an individual that is diagnosed with, or who is deemed to be at risk of being afflicted by any of the aforementioned diseases or disorders. In some instances the subject may be in an advanced state of CoV infection, e.g., a subject who is on a ventilator. In some instances, the subject can be one having one or more risk factors (such as advanced age, obesity, diabetes, etc, and others previously identified) which correlate to a poor CoV treatment or recovery prognosis. The present disclosure further includes the use of any of the pharmaceutical formulations disclosed herein in the manufacture of a medicament for the treatment, prevention and/or amelioration of any disease or disorder associated with CoV or CoV-S activity (including any of the above-mentioned exemplary diseases, disorders and conditions).

J. Administration

In one embodiment, the anti-CoV-S antibodies described herein, or CoV-S binding fragments thereof, as well as combinations of said antibodies or antigen-binding fragments thereof, are administered to a subject at a concentration of between 0.1 mg/ml and about any one of 0.5, 1, 5, 10, 15 20, 25, 30, 35, 40, 45, 50, 55, 60, 65, 70, 75, 80, 85, 90, 95, 100, 110, 120, 130, 140, 150, 160, 170, 180, 190, or 200 mg/ml, +/−10% error.

In another embodiment, the anti-CoV-S antibodies and fragments thereof described herein are administered to a subject at a dose of between about 0.01 and 100.0 or 200.0 mg/kg of body weight of the recipient subject. In certain embodiments, depending on the type and severity of the CoV-S-related disease, about 1 µg/kg to 50 mg/kg (e.g., 0.1-20 mg/kg) of antibody is an initial candidate dosage for administration to the patient, whether, for example, by one or more separate administrations, or by continuous infusion. In another embodiment, about 1 µg/kg to 15 mg/kg (e.g., 0.1 mg/kg-10 mg/kg) of antibody is an initial candidate dosage for administration to the patient. A typical daily dosage might range from about 1 µg/kg to 100 mg/kg or more, depending on several factors, e.g., the particular mammal being treated, the clinical condition of the individual patient, the cause of the disorder, the site of delivery of the agent, the method of administration, the scheduling of administration, and other factors known to medical practitioners. However, other dosage regimens may be useful.

For example, in addition to the relative dosages (mg/kg) discussed herein, the subject anti-CoV-S antibodies and antigen-binding fragments thereof can be administered to a subject at an absolute dose (mg). Accordingly, in one embodiment, the anti-CoV-S antibodies and antigen-binding fragments thereof described herein are administered to a subject at a dose of between about 1 microgram and about 1000 milligrams regardless of the route of administration.

In a preferred embodiment, the anti-CoV-S antibodies described herein, or anti-CoV-S antigen-binding fragments thereof, as well as combinations of said antibodies or antigen-binding fragments thereof, are administered to a recipient subject with a frequency of once every twenty-six weeks or less, such as once every sixteen weeks or less, once every eight weeks or less, once every four weeks or less, once every two weeks or less, once every week or less, or once daily or less.

According to preferred embodiments, the antibody containing medicament or pharmaceutical composition is peripherally administered to a subject via a route selected from one or more of: orally, sublingually, buccally, topically, rectally, via inhalation, transdermally, subcutaneously, intravenously, intra-arterially, or intramuscularly, via intracardiac administration, intraosseously, intradermally, intraperitoneally, transmucosally, vaginally, intravitreally, epicutaneously, intra-articularly, peri-articularly, or locally.

Fab fragments may be administered every two weeks or less, every week or less, once daily or less, multiple times per day, and/or every few hours. In one embodiment, a patient receives Fab fragments of 0.1 mg/kg to 40 mg/kg per day given in divided doses of 1 to 6 times a day, or in a continuous perfusion form, effective to obtain desired results.

It is to be understood that the concentration of the antibody or Fab administered to a given patient may be greater or lower than the exemplary administration concentrations set forth above.

A person of skill in the art would be able to determine an effective dosage and frequency of administration through routine experimentation, for example guided by the disclosure herein and the teachings in, *Goodman & Gilman's The Pharmacological Basis of Therapeutics*, Brunton, L. L. et al. editors, 11$^{th}$ edition, New York, N.Y.: McGraw-Hill (2006); Howland, R. D. et al., *Pharmacology, Volume 864, Lippincott's illustrated reviews*., Philadelphia, Pa.: Lippincott Williams & Wilkins (2006); and Golan, D. E., *Principles of pharmacology: the pathophysiologic basis of drug therapy*, Philadelphia, Pa.: Lippincott Williams & Wilkins (2007).

In another embodiment, the anti-CoV-S antibodies described herein, or CoV-S binding fragments thereof, as well as combinations of said antibodies or antigen-binding fragments thereof, are administered to a subject in a pharmaceutical formulation. In a preferred embodiment, the subject is a human.

A "pharmaceutical composition" or "medicament" refers to a chemical or biological composition suitable for administration to a subject, preferably a mammal, more preferably a human Such compositions may be specifically formulated for administration via one or more of a number of routes, including but not limited to buccal, epicutaneous, epidural, inhalation, intraarterial, intracardial, intracerebroventricular, intradermal, intramuscular, intranasal, intraocular, intraperitoneal, intraspinal, intrathecal, intravenous, oral, parenteral, rectally via an enema or suppository, subcutaneous, subdermal, sublingual, transdermal, and transmucosal. In addition, administration can occur by means of injection, powder, liquid, gel, drops, or other means of administration.

In one embodiment, the anti-CoV-S antibodies or antigen-binding fragments thereof, as well as combinations of said antibodies or antigen-binding fragments thereof, may be optionally administered in combination with one or more active agents. Such active agents include (i) an antiviral drug, optionally, remdesivir, favipiravir, darunavir, nelfinavir, saquinavir, lopinavir, or ritonavir; (ii) an antihelminth drug, optionally ivermectin; (iii) an antiparasitic drug, optionally hydroxychloroquine, chloroquine, or atovaquone; (iv) antibacterial vaccine, optionally the tuberculosis vaccine BCG; or (v) an anti-inflammatory drug, optionally a steroid such as ciclesonide, a TNF inhibitor (e.g., adalimumab), a TNF receptor inhibitor (e.g., etanercept), an IL-6 inhibitor (e.g., clazakizumab), an IL-6 receptor inhibitor (e.g., toclizumab), or metamizole; (vi) an antihistamine drug, optionally bepotastine; (vii) an ACE inhibitor, optionally moexipril; or (viii) a drug that inhibits priming of CoV-S, optionally a serine protease inhibitor, further optionally nafamostat.

An anti-histamine can be any compound that opposes the action of histamine or its release from cells (e.g., mast cells). Anti-histamines include but are not limited to acrivastine, astemizole, azatadine, azelastine, betatastine, brompheniramine, buclizine, cetirizine, cetirizine analogues, chlorpheniramine, clemastine, CS 560, cyproheptadine, desloratadine, dexchlorpheniramine, ebastine, epinastine, fexofenadine, HSR 609, hydroxyzine, levocabastine, loratadine, methscopolamine, mizolastine, norastemizole, phenindamine, promethazine, pyrilamine, terfenadine, and tranilast.

In CoV infection, respiratory symptoms are often exacerbated by additional bacterial infection. Therefore, such active agents may also be antibiotics, which include but are not limited to amikacin, aminoglycosides, amoxicillin, ampicillin, ansamycins, arsphenamine, azithromycin, azlocillin, aztreonam, bacitracin, carbacephem, carbapenems, carbenicillin, cefaclor, cefadroxil, cefalexin, cefalothin, cefalotin, cefamandole, cefazolin, cefdinir, cefditoren, cefepime, cefixime, cefoperazone, cefotaxime, cefoxitin, cefpodoxime, cefprozil, ceftazidime, ceftibuten, ceftizoxime, ceftobiprole, ceftriaxone, cefuroxime, cephalosporins, chloramphenicol, cilastatin, ciprofloxacin, clarithromycin, clindamycin, cloxacillin, colistin, co-trimoxazole, dalfopristin, demeclocycline, dicloxacillin, dirithromycin, doripenem, doxycycline, enoxacin, ertapenem, erythromycin, ethambutol, flucloxacillin, fosfomycin, furazolidone, fusidic acid, gatifloxacin, geldanamycin, gentamicin, glycopeptides, herbimycin, imipenem, isoniazid, kanamycin, levofloxacin, lincomycin, linezolid, lomefloxacin, loracarbef, macrolides, mafenide, meropenem, methicillin, metronidazole, mezlocillin, minocycline, monobactams, moxifloxacin, mupirocin, nafcillin, neomycin, netilmicin, nitrofurantoin, norfloxacin, ofloxacin, oxacillin, oxytetracycline, paromomycin, penicillin, penicillins, piperacillin, platensimycin, polymyxin B, polypeptides, prontosil, pyrazinamide, quinolones, quinupristin, rifampicin, rifampin, roxithromycin, spectinomycin, streptomycin, sulfacetamide, sulfamethizole, sulfanilamide, sulfasalazine, sulfisoxazole, sulfonamides, teicoplanin, telithromycin, tetracycline, tetracyclines, ticarcillin, tinidazole, tobramycin, trimethoprim, trimethoprim-sulfamethoxazole, troleandomycin, trovafloxacin, and vancomycin.

Active agents also include aldosterone, beclomethasone, betamethasone, corticosteroids, cortisol, cortisone acetate, deoxycorticosterone acetate, dexamethasone, fludrocortisone acetate, glucocorticoids, hydrocortisone, methylprednisolone, prednisolone, prednisone, steroids, and triamcinolone. Any suitable combination of these active agents is also contemplated.

A "pharmaceutical excipient" or a "pharmaceutically acceptable excipient" is a carrier, usually a liquid, in which an active therapeutic agent is formulated. In one embodiment, the active therapeutic agent is a humanized antibody described herein, or one or more fragments thereof. The excipient generally does not provide any pharmacological activity to the formulation, though it may provide chemical and/or biological stability, and release characteristics. Exemplary formulations can be found, for example, in Remington's Pharmaceutical Sciences, Gennaro, A. editor, 19$^{th}$ edition, Philadelphia, Pa.: Williams and Wilkins (1995), which is incorporated by reference.

As used herein "pharmaceutically acceptable carrier" or "excipient" includes any and all solvents, dispersion media, coatings, antibacterial and antifungal agents, isotonic, and absorption delaying agents that are physiologically compatible. In one embodiment, the carrier is suitable for parenteral administration. Alternatively, the carrier can be suitable for intravenous, intraperitoneal, intramuscular, or sublingual administration. Pharmaceutically acceptable carriers include sterile aqueous solutions or dispersions and sterile powders for the extemporaneous preparation of sterile injectable solutions or dispersions. The use of such media and agents for pharmaceutically active substances is well known in the art. Except insofar as any conventional media or agent is incompatible with the active compound, use thereof in the pharmaceutical compositions of the disclosure is contemplated. Supplementary active compounds can also be incorporated into the compositions.

Pharmaceutical compositions typically must be sterile and stable under the conditions of manufacture and storage. The disclosure contemplates that the pharmaceutical composition is present in lyophilized form. The composition can be formulated as a solution, microemulsion, liposome, or other ordered structure suitable to high drug concentration. The carrier can be a solvent or dispersion medium containing, for example, water, ethanol, polyol (for example, glycerol, propylene glycol, and liquid polyethylene glycol), and suitable mixtures thereof. The disclosure further contemplates the inclusion of a stabilizer in the pharmaceutical composition. The proper fluidity can be maintained, for example, by the maintenance of the required particle size in the case of dispersion and by the use of surfactants.

In many cases, it will be preferable to include isotonic agents, for example, sugars, polyalcohols such as mannitol and sorbitol, or sodium chloride in the composition. Absorption of the injectable compositions can be prolonged by including an agent that delays absorption, for example, monostearate salts and gelatin. Moreover, the alkaline polypeptide can be formulated in a time-release formulation, for example in a composition that includes a slow release polymer. The active compounds can be prepared with carriers that will protect the compound against rapid release, such as a controlled release formulation, including implants and microencapsulated delivery systems. Biodegradable, biocompatible polymers can be used, such as ethylene vinyl acetate, polyanhydrides, poly glycolic acid, collagen, polyorthoesters, polylactic acid, polylactic and polyglycolic copolymers ("PLG"). Many methods for the preparation of such formulations are known to those skilled in the art.

For each of the recited embodiments, the compounds can be administered by a variety of dosage forms. Any biologically acceptable dosage form known to persons of ordinary skill in the art, and combinations thereof, are contemplated.

Examples of such dosage forms include, without limitation, reconstitutable powders, elixirs, liquids, solutions, suspensions, emulsions, powders, granules, particles, microparticles, dispersible granules, cachets, inhalants, aerosol inhalants, patches, particle inhalants, implants, depot implants, injectables (including subcutaneous, intramuscular, intravenous, and intradermal), infusions, and combinations thereof.

The above description of various illustrated embodiments of the disclosure is not intended to be exhaustive or to limit the disclosure to the precise form disclosed. While specific embodiments of, and examples for, the disclosure are described herein for illustrative purposes, various equivalent modifications are possible within the scope of the disclosure, as those skilled in the relevant art will recognize. The teachings provided herein of the disclosure can be applied to other purposes, other than the examples described herein.

Certain anti-CoV-S antibody polynucleotides and polypeptides are disclosed in the sequence listing accompanying this patent application filing, and the disclosure of said sequence listing is herein incorporated by reference in its entirety.

The entire disclosure of each document cited (including patents, patent applications, journal articles, abstracts, manuals, books, or other disclosures) in the Background, Detailed Description, and Examples is herein incorporated by reference in their entireties.

The following examples are put forth so as to provide those of ordinary skill in the art with a complete disclosure and description of how to make and use the subject disclosure and are not intended to limit the scope of what is regarded as the invention. Efforts have been made to ensure accuracy with respect to the numbers used (e.g. amounts, temperature, concentrations, etc.), but some experimental errors and deviations should be allowed for. Unless otherwise indicated, parts are parts by weight, molecular weight is average molecular weight, temperature is in degrees centigrade; and pressure is at or near atmospheric.

EXAMPLES

Example 1: Selection and Preparation of Antibodies that Selectively Bind SARS-CoV-S and/or SARS-CoV-2-S—Using a Blood Sample from a SARS Survivor Studies of antibody responses to other CoVs have shown that the S glycoprotein is the primary target for neutralizing antibodies (nAbs) (Jiang, C. Hillyer, L. Du, Trends Immunol. Apr. 24, 2020. pii: 51471-4906(20)30087-9). Given that SARS-CoV and SARS-CoV-2 share about 80% amino acid identity in their S proteins, one important immunological question concerns the immunogenicity of conserved surfaces on this antigen. Recent studies have demonstrated that there is little to no cross-neutralizing activity in convalescent SARS or COVID-19 sera, suggesting that conserved antigenic sites are rarely targeted by nAbs (X. Ou et al., Nat Commun Mar. 27, 2020; 11(1):1620). Correspondingly, studies of small panels of human and murine mAbs induced by SARS-CoV infection or vaccination have shown that cross-reactivity with SARS-CoV-2 is uncommon (D. Wrapp et al., Science. Mar. 13, 2020; 367(6483):1260-1263; Q. Wang et al., Cell. Apr. 7, 2020. pii: S0092 8674(20)30338-X). To define conserved epitopes shared between SARS-CoV and SARS-CoV-2, the memory B cell repertoire of a 2003 SARS survivor was mined for SARS-CoV-2 cross-reactive antibodies.

Sample

Heparinized blood (50-100 cc) was obtained from a subject (2003 SARS outbreak survivor) 17 years after infection with SARS-CoV (Donor name "VRC #202367"). The sample was processed to obtain plasma and to isolate peripheral blood-derived B cells. Isolated cells and plasma were stored frozen in aliquots at −80° C.

Antigens and Antibodies

Production of recombinant SARS-CoV and SARS-CoV-2 spike protein: To express the prefusion S ectodomain of SARS-CoV-2, a gene encoding residues 1-1208 of 2019-nCoV S (GenBank: MN908947) with proline substitutions at residues 986 and 987, a "GSAS" substitution ("GSAS" disclosed as SEQ ID NO: 23196) at the furin cleavage site (residues 682-685), a C-terminal T4 fibritin trimerization motif, an HRV3C protease cleavage site, a TwinStrepTag and an 8XHisTag (SEQ ID NO: 23197) was synthesized and cloned into the mammalian expression vector pαH (DOI: 10.1126/science.abb2507). The prefusion S ectodomain of SARS-CoV was also expressed in the same manner Expression construct design was based on previously described strategies for expression of related betacoronavirus S proteins (DOI: 10.1073/pnas.1707304114 and DOI: 10.1038/s41598-018 34171-7) These expression vector encoding SARS-CoV-2 S protein was used to transiently transfect FreeStyle293F cells (Thermo 134 Fischer) using polyethylenimine Protein was purified from filtered cell supernatants using either 135 StrepTactin resin (IBA) or Protein A resin (Pierce) before being subjected to additional 136 purification by size-exclusion chromatography using either a Superose 6 10/300 column (GE 137 Healthcare) or a Superdex 200 10/300 Increase column (GE Healthcare) in 2 mM Tris pH 8.0, 138 200 mM NaCl and 0.02% NaN3. The final protein preparations were stored in phosphate-buffered saline pH 7.4 supplemented with an additional 150 mM NaCl Small aliquots were stored at −70° C. until use.

Single B-Cell Sorting

For MBC sorting, B cells were purified using a MACS B cell isolation kit (Miltenyi Biotec; cat #130-091-151) and subsequently stained using anti-human CD19 (PE-Cy7), CD3 (PerCP-Cy5.5), CD8 (PerCP-Cy5.5), CD14 (PerCP-Cy5.5), CD16 (PerCP-Cy5.5), IgM (BV711), IgD (BV421), IgA (AF488), IgG (BV605), CD27 (BV510), CD71 (APC-Cy7) and a mixture of dual-labeled (APC and PE) SARS-CoV and/or SARS-CoV-2 spike protein tetramers (25 nM each). Tetramers were prepared fresh for each experiment, and B cells that showed reactivity to the SARS-CoV and/or SARS-CoV-2 spike protein tetramers were single cell sorted. Single cells were sorted using a BD FACS Aria II (BD Biosciences) into 96-well PCR plates (BioRAD) containing 20 uL/well of lysis buffer [5 uL of 5× first strand cDNA buffer (Invitrogen), 0.625 uL of NP-40 (New England Biolabs), 0.25 uL RNaseOUT (Invitrogen), 1.25 uL dithiothreitol (Invitrogen), and 12.6 uL dH2O]. Plates were immediately stored at −80° C. Flow cytometry data were analyzed using FlowJo software.

As shown in FIG. 6A, flow cytometric analysis revealed that approximately 0.15% of class-switched memory B cells were SARS-CoV-2 S-reactive, which was about 3-fold over background staining observed with a SARS-CoV-naïve donor sample. Notably, the frequency of antigen-specific memory B cells was higher than expected, given the long interval between infection and blood draw (17 years) and previous studies showing that SARS-CoV-specific memory B cells typically wane to undetectable levels after only 6 years (Tang F. et al., J Immunol. Jun. 15, 2011; 186(12): 7264-8).

Amplification and Cloning of Antibody Variable Genes

Antibody variable genes (IgH, IgK, and IgL) were amplified by reverse transcription PCR and nested PCRs using cocktails of IgG- and IgM-specific primers, as described previously (Tiller et al, J Immunol 2008). The primers used in the second round of PCR contained 40 base pairs of 5' and 3' homology to the digested expression vectors, which allowed for cloning by homologous recombination into *S. cerevisiae*. The lithium acetate method for chemical transformation was used to clone the PCR products into *S. cerevisiae* (Gietz and Schiestl, Nat Protoc 2007). 10 uL of unpurified heavy chain and light chain PCR product and 200 ng of the digested expression vectors were used per transformation reaction. Following transformation, individual yeast colonies were picked for sequencing and characterization. Cognate antibody heavy- and light-chain pairs were rescued from 315 individual SARS-CoV-2-reactive B cells and cloned. The sequences, the germline origins, and isotypes were determined. The number of nucleic acid substitutions relative to the germline sequences and the number of amino acid alterations relative to the germline-encoded sequences were also analyzed.

The results are shown in FIGS. 3-6. Sequence analysis revealed that about half of the clones were members of expanded clonal lineages (the combination of VH1-69 and VK2-30 (shown in blue), or other combinations (shown in dark gray) such as those of VH1-69 and a VL that is not VK2-30), whereas the other half were unique (FIG. 6C). This result contrasts with many studies of other primary viral infections, which have shown a limited degree of clonal expansion within the antigen-specific memory B cell repertoire (Rogers T. F. et al., *Sci Immunol*. Aug. 18, 2017; 2(14); Goodwin E., et al., *Immunity*. Feb. 20, 2018; 48(2); Bornholdt Z. A., et al., *Science*. Mar. 4, 2016; 351(6277):1078-83; Wec A. Z., et al., Proc Natl Acad Sci USA. Mar. 24, 2020; 117(12):6675-6685). In addition, many clonally unrelated antibodies displayed convergent VH1-69/VK2-30 germline gene pairing (FIG. 6C). As expected, almost all of the isolated antibodies were somatically mutated, with members of clonally expanded lineages showing higher levels of somatic hypermutation (SHM) compared to unique clones (FIG. 6D). Finally, index sorting analysis indicated that 33% and 66% of binding antibodies originated from IgA+ and IgG+ memory B cells, respectively (FIG. 6E). These results suggest that SARS-CoV infection elicited a high frequency of long-lived, cross-reactive memory B cells (MBCs) in this donor.

Expression and Purification of IgGs and Fab Fragments

IgGs were expressed in *S. cerevisiae* cultures grown in 24-well plates, as described previously (Bornholdt et al, Science 2016, PMID:26912366). After 6 days, the cultures were harvested by centrifugation and IgGs were purified by protein A-affinity chromatography. The bound antibodies were eluted with 200 mM acetic acid/50 mM NaCl (pH 3.5) into ⅛th volume 2 M Hepes (pH 8.0), and buffer-exchanged into PBS (pH 7.0). Of the 315 cloned antibodies, 202 bound to SARS-CoV-2 S in preliminary binding screens (FIG. 6B).

The antibody CR3022 was cloned into *S. cerevisiae* using recombinational cloning. The variable region sequences of CR3022 were synthesized as gBlock fragments (IDT) with homologous overhangs which were cloned and expressed as described above.

Fab fragments were generated by digesting the IgGs with papain for 2h at 30° C. The digestion was terminated by the addition of iodoacetamide, and the Fab and Fc mixtures were passed over Protein A agarose to remove Fc fragments and undigested IgG. The flowthrough of the Protein A resin was then passed over CaptureSelect™ IgG-CH1 affinity resin (ThermoFischer Scientific), and eluted with 200 mM acetic acid/50 mM NaCl pH 3.5 into ⅛th volume 2M Hepes pH 8.0. Fab fragments then were buffer-exchanged into PBS pH 7.0.

Example 2: Kinetics of Binding Measurements (S Protein of SARS-CoV and SARS-CoV-2)

Next, the apparent binding affinities ($K_D^{APPs}$) of the antibodies to prefusion-stabilized SARS-CoV and SARS-CoV-2 S proteins was measured (D. Wrapp et al., Cryo-EM structure of the 2019-nCoV spike in the prefusion conformation. *Science* 367, 1260-1263 (2020)).

Bio-Layer Interferometry Kinetic Measurements (BLI):

For monovalent apparent KD determination, IgG binding to recombinant SARS CoV or SARS-CoV-2 spike protein antigen was measured by biolayer interferometry (BLI) using a FortéBio Octet HTX instrument (Molecular Devices). The IgGs were captured (1.5 nm) to anti-human IgG capture (AHC) biosensors Molecular Devices) and allowed to stand in PBSF (PBS with 0.1% w/v BSA) for a minimum of 30 min. After a short (60 s) baseline step in PBSF, the IgG-loaded biosensor tips were exposed (180 s, 1000 rpm of orbital shaking) to SARS CoV or SARS-CoV-2 spike protein (100 nM in PBSF) and then dipped (180 s, 1000 rpm of orbital shaking) into PBSF to measure any dissociation of the antigen from the biosensor tip surface. Data for which binding responses were >0.1 nm were aligned, inter-step corrected (to the association step) and fit to a 1:1 binding model using the FortéBio Data Analysis Software, version 11.1.

For bivalent apparent KD determination, IgG binding to the SARS-CoV-2 NTD and RBD was measured by BLI using a FortéBio Octet HTX instrument (Molecular Devices). Recombinant biotinylated antigens were immobilized on streptavidin biosensors (Molecular Devices) and allowed to stand in PBSF (PBS with 0.1% w/v BSA) for a minimum of 30 min. After a short (60 s) baseline step in PBSF, the antigen-loaded biosensor tips were exposed (180 s, 1000 rpm of orbital shaking) to the IgGs (100 nM in PBSF) and then dipped (180 s, 1000 rpm of orbital shaking) into PBSF to measure any dissociation of the IgGs from the biosensor tip surface. Data for which binding responses were >0.1 nm were aligned, interstep corrected (to the association step) and fit to a 1:1 binding model using the FortéBio Data Analysis Software, version 11.1.

The SARS-CoV-2 S1 subunit was purchased from Acro Biosystems (Cat #S1N-C52H3) and SARS-CoV-2 S2 subunit was purchased from Sino Biological (Cat #S2N-C52H5).

Figure 14A:
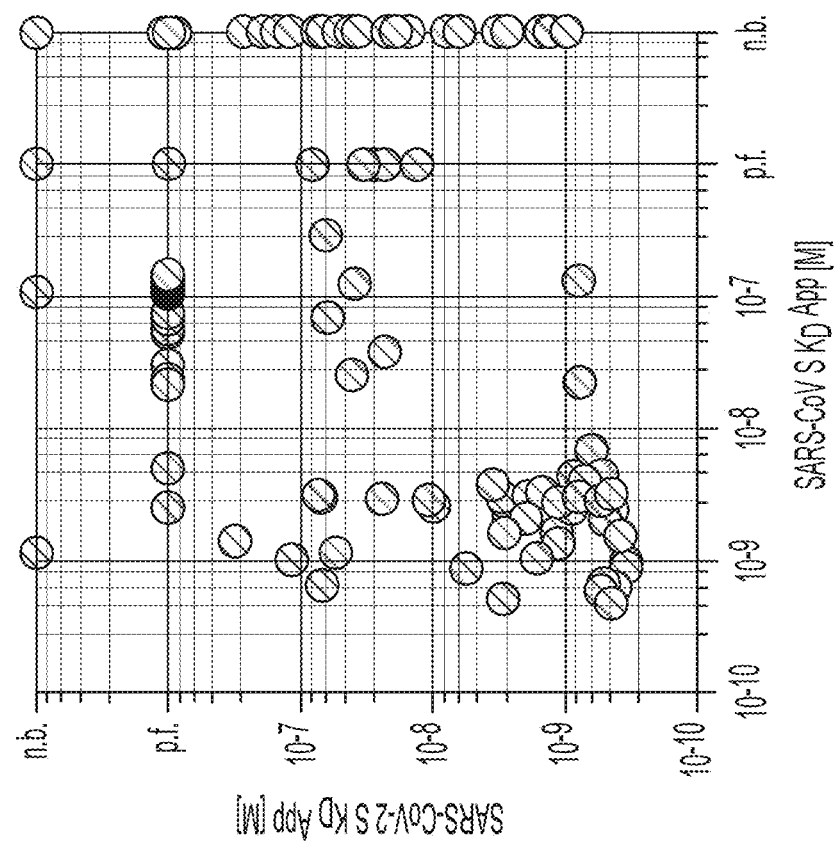
FIGS. 14A-14L contain a summary of the binding properties of SARS-CoV-2 S-specific antibodies based on the results from Examples 2 and 3.
Figure 14B:
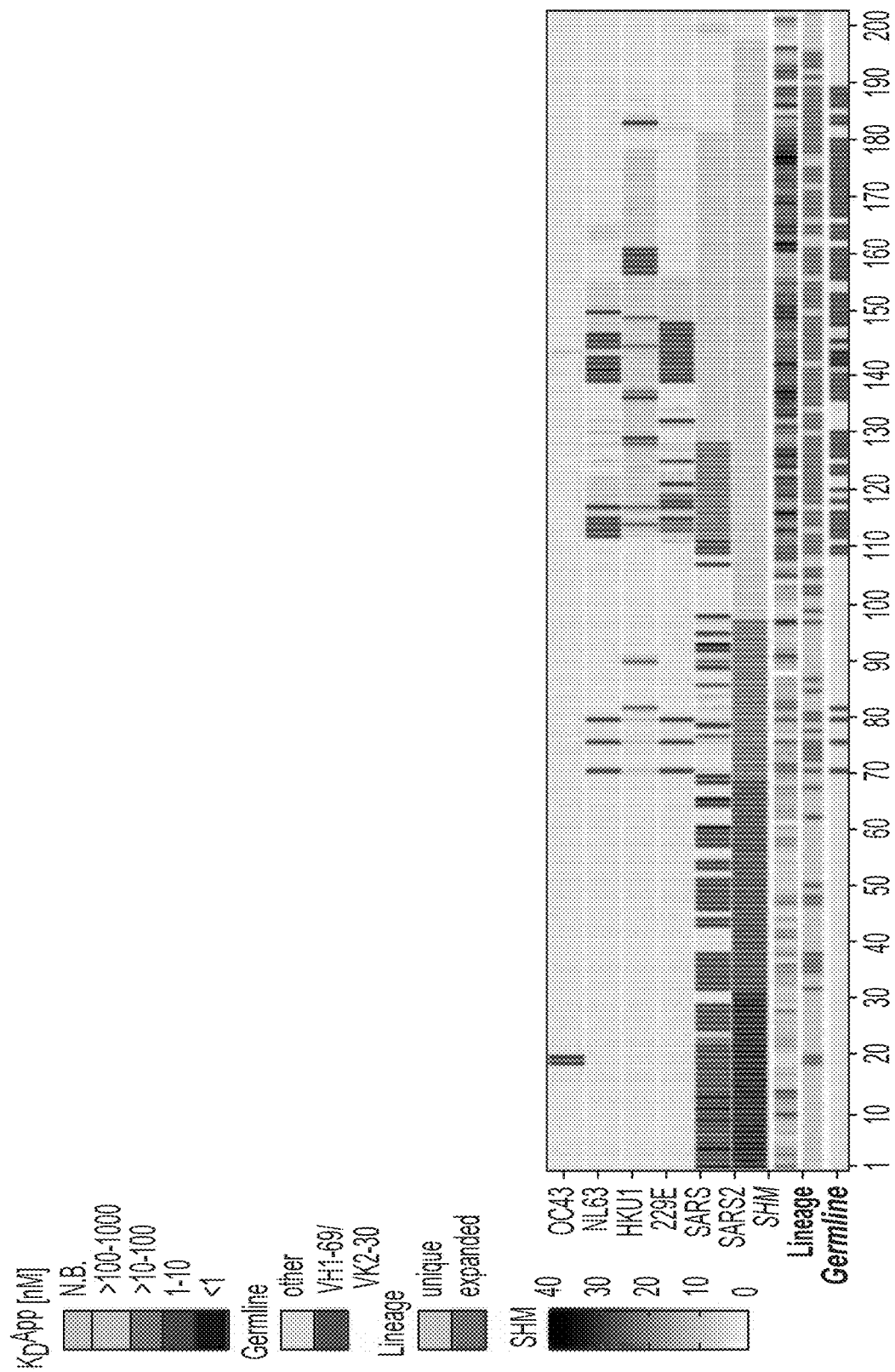
Figure 14E:
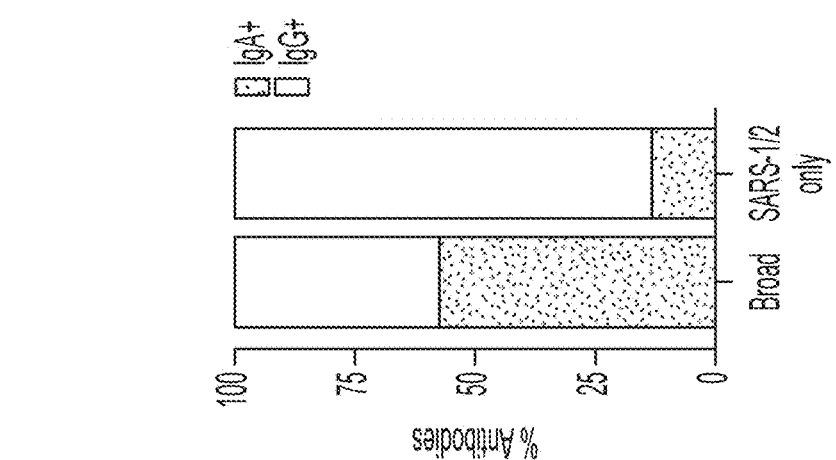
Figure 14D:
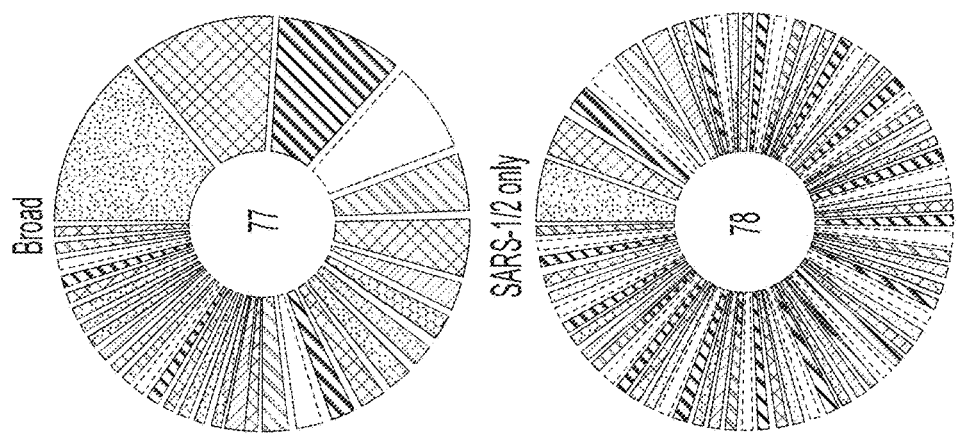
Figure 14C:
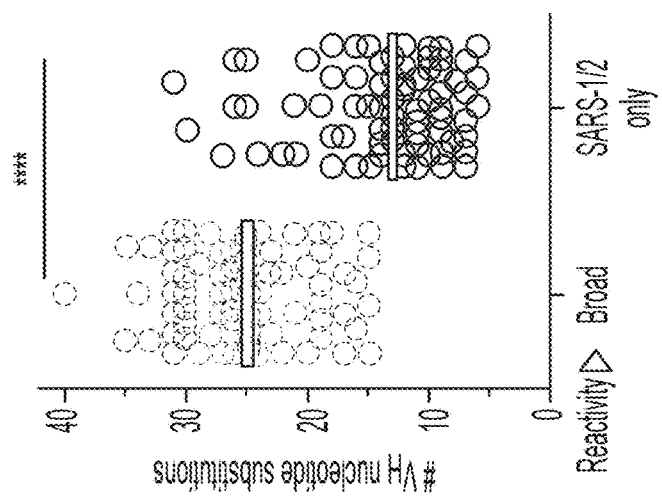
Figure 20F:
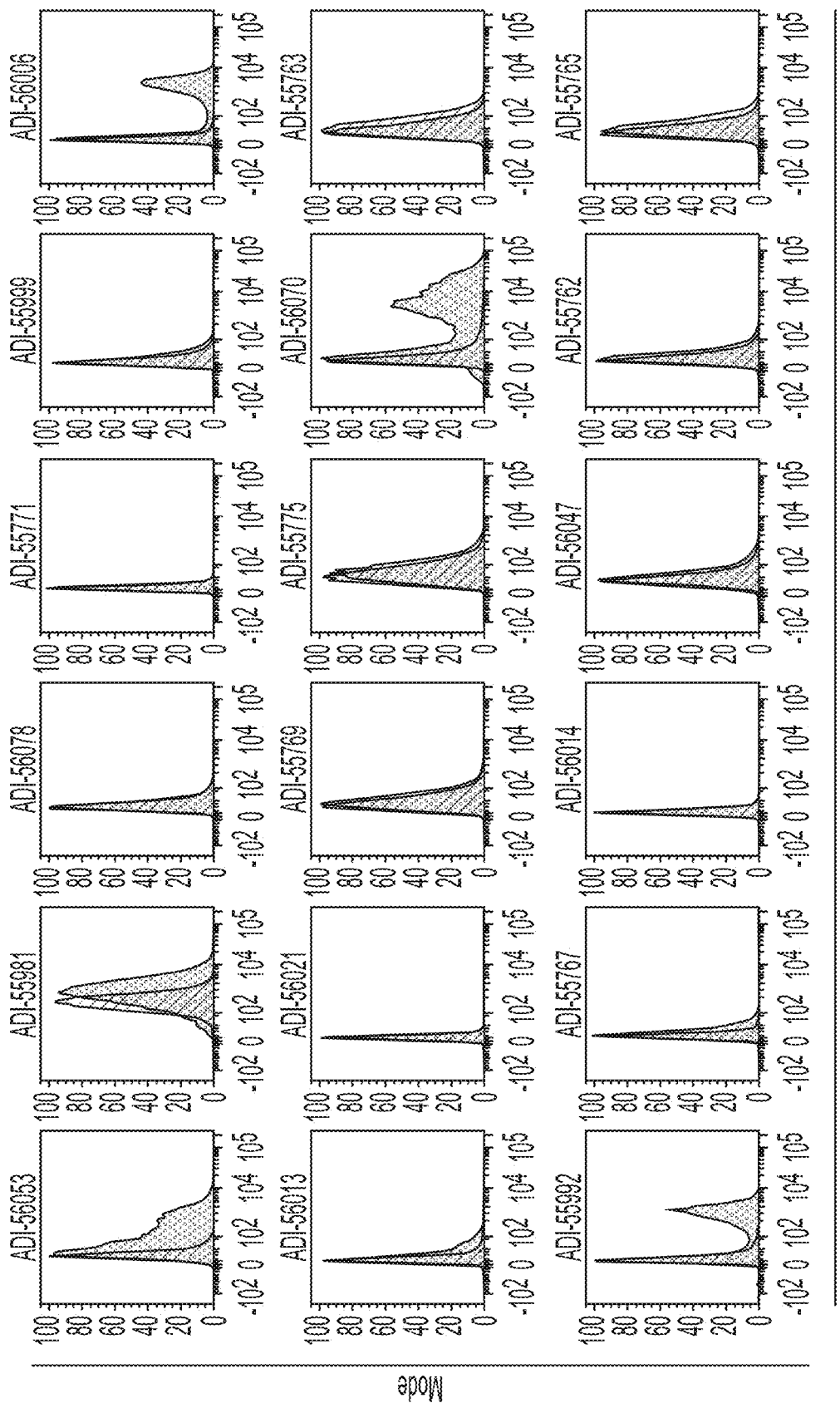
Figure 20F:
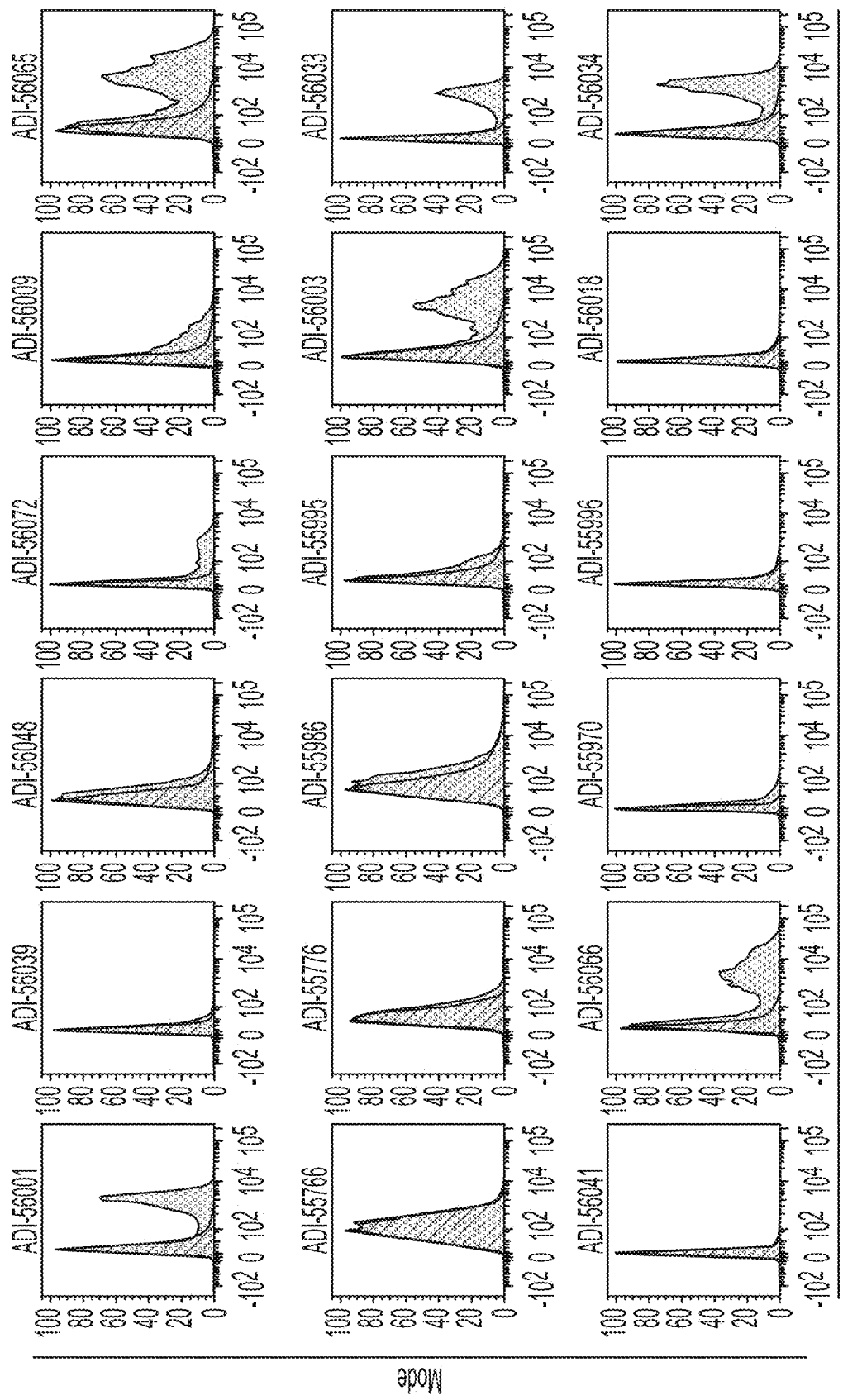
Figure 20F:
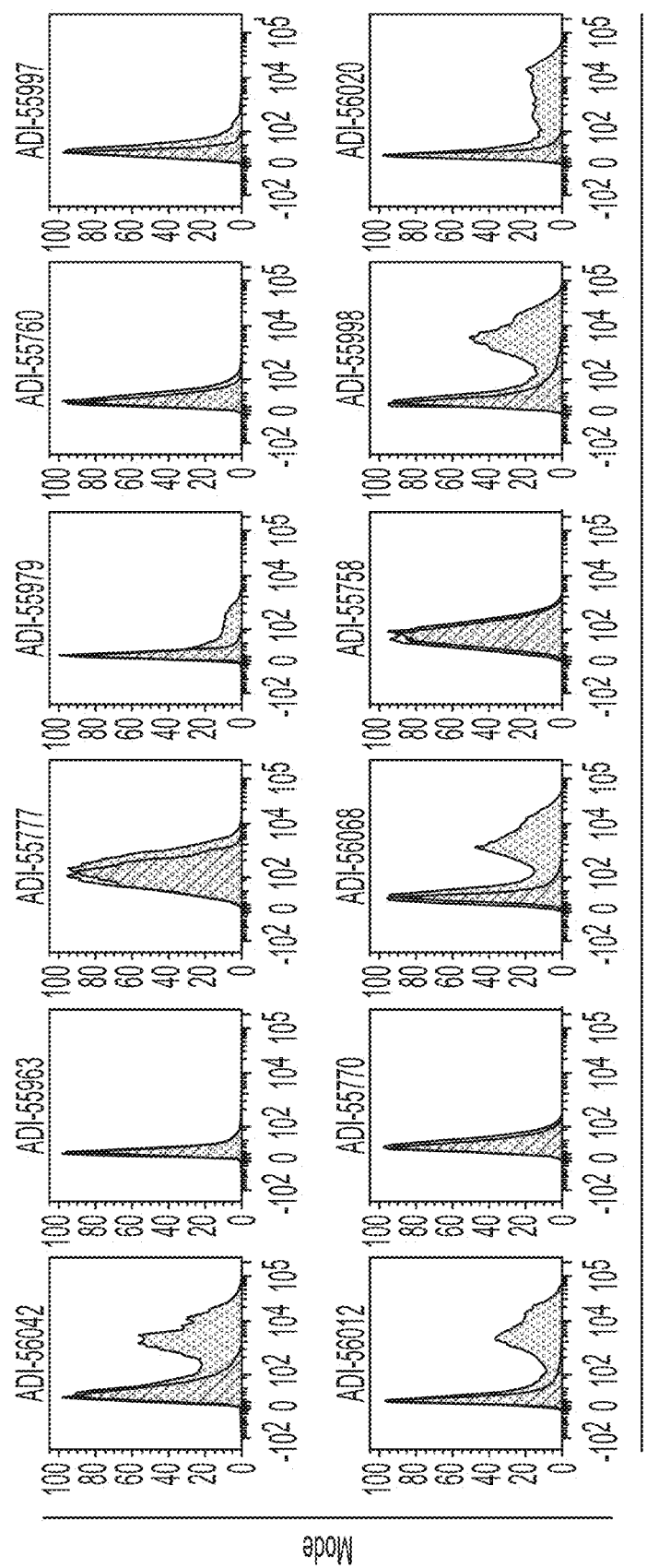

The binding kinetics for all tested antibodies are provided in FIG. 7. Binding affinities (KD [M]) for SARS-CoV-S and SARS-CoV-2-S for each antibody are shown in a dot plot in FIG. 14A. While the majority of mAbs (153 out of 202) showed binding to both SARS-CoV-2 and SARS-CoV S, a subset of mAbs appeared to be SARS-CoV-2 S-specific. This result was unexpected given the mAbs were isolated from a donor who had been infected with SARS-CoV and may relate to differences between the infecting SARS-CoV strain and the recombinant SARS-CoV S protein (Tor2) used for the binding studies. Alternatively, this result may be due to inherent differences in the stability or antigenicity of recombinant prefusion-stabilized SARS-CoV and SARS-CoV-2 S proteins. Indeed, about 30% of antibodies that failed to bind recombinant SARS-CoV S displayed reactivity with SARS-CoV S expressed on the surface of transfected cells, providing some evidence for differences in the antigenicity of recombinant and cell-expressed forms of S (FIG. 20F). Interestingly, most of the highly mutated and clonally expanded antibodies bound to both SARS-CoV and SARS-CoV-2 S with $K_D^{APP}$>10 nM (FIG. 14B).

Example 3: Kinetics of Binding Measurements (S Protein of Circulating/Seasonal CoV Species)

Next, it was determined whether these antibodies originated from pre-existing MBCs that were induced by prior exposures to naturally circulating HCoVs, which share up to 32% amino acid identity with SARS-CoV and SARS-CoV-2 in their S proteins. Accordingly, binding affinities to the S protein of HCoV-229E, HCoV-HKU1, HCoV-NL63, and HCoV-0K43 were measured and analyzed in a similar manner as in Example 2. The S proteins from 229E, NL63 and OC43 were purchased from Sino Biological (Cat. #40605-V08B, 40604-V08B and 40607-V08B).

Results are shown in FIGS. 22-25.

Based on the results from Examples 2 and 3, the binding specificity/the broadness of the reactivity for each antibody was determined (FIG. 12). Antibodies with the binding response value (nM) of 0.1 or higher for a given target were considered as binders and shown as "Yes". Also antibodies with a binding response value such as 0.099 or 0.098 that can be round up to 0.1 were also identified as binders and shown as "Yes". Antibodies with the binding response value (nM) of <0.1 for a given target were considered to be non-binders and shown as "No". Antibodies that are "Yes" for SARS-CoV-S and/or SARS-CoV-2-S but "No" for all of the S proteins of HCoV-229E, HCoV-HKU1, HCoV-NL63, and HCoV-OK43 were classified as "SARS 1-2 specific". Antibodies that are "Yes" for SARS-CoV-S and/or SARS-CoV-2-S and "Yes" for at least one of the S proteins of HCoV-229E, HCoV-HKU1, HCoV-NL63, and HCoV-0K43 were classified as "Broad" (binders).

Poly specificity (also referred to as polyreactivity) is a highly undesirable property that has been linked to poor antibody pharmacokinetics (Wu et al., J Mol Biol 368:652-665, 2007; Hötzel et al., 2012, MAbs 4(6):753-760) and, thus, potentially to poor developability. Antibodies can be detected as possessing decreased or increased developability by virtue of their level of interaction with poly specificity reagent (PSR). See WO2014/179363. Antibodies displaying increased interaction with PSR are referred to as "polyspecific" polypeptides, with poor(er) developability. SARS2 antibodies selected or identified as possessing enhanced developability based on low polyspecificity score are considered "developable".

Figures 14F, 14G:
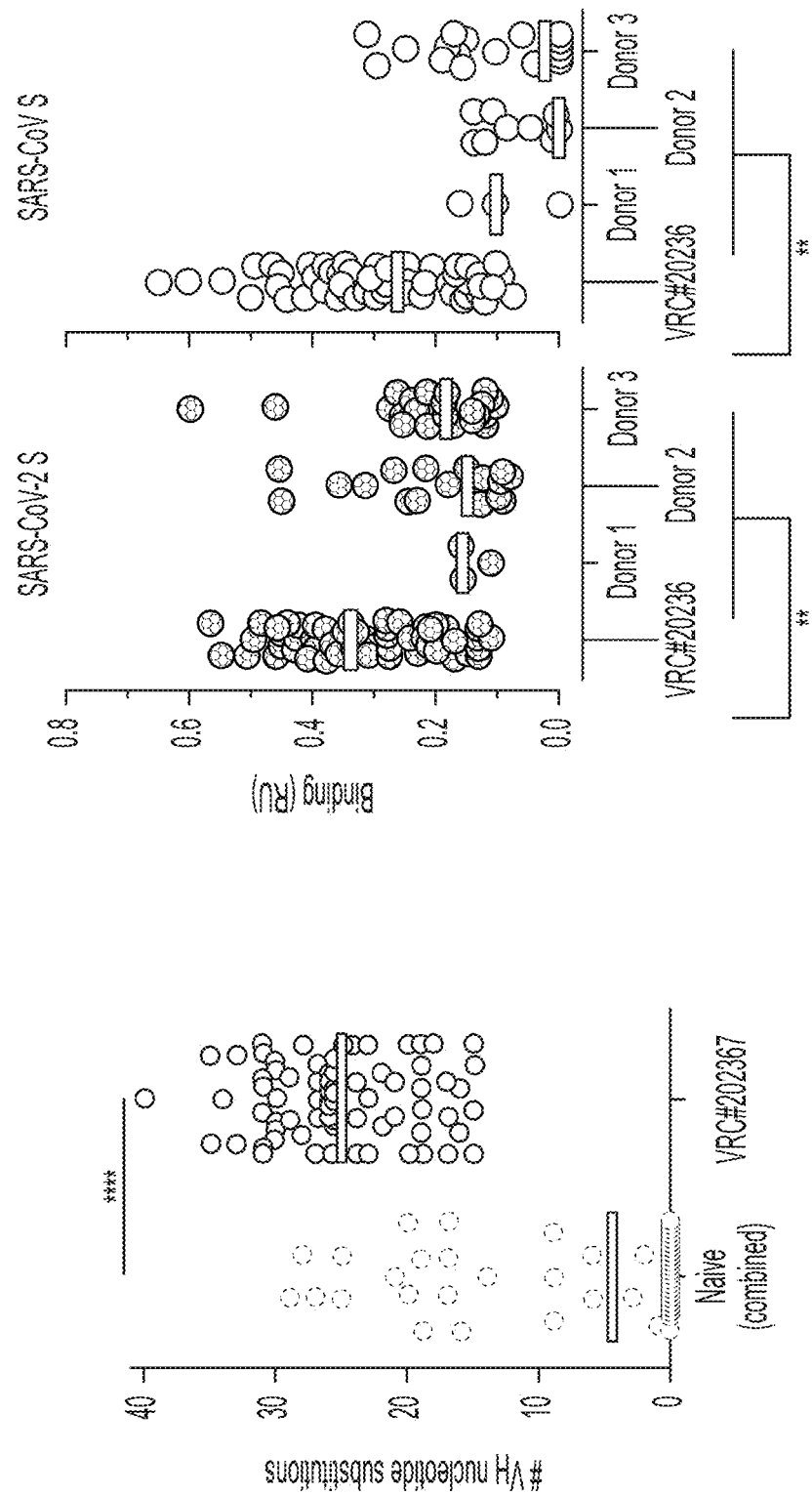
Figures 14H, 14I:
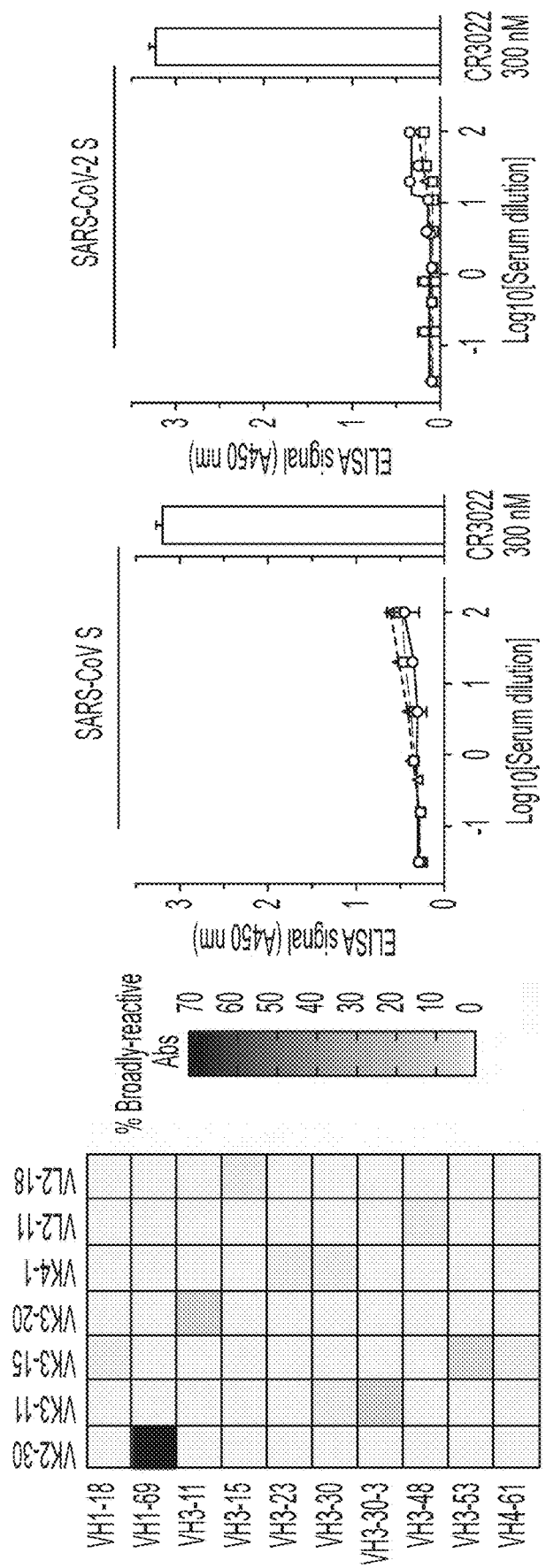
Figure 14J:
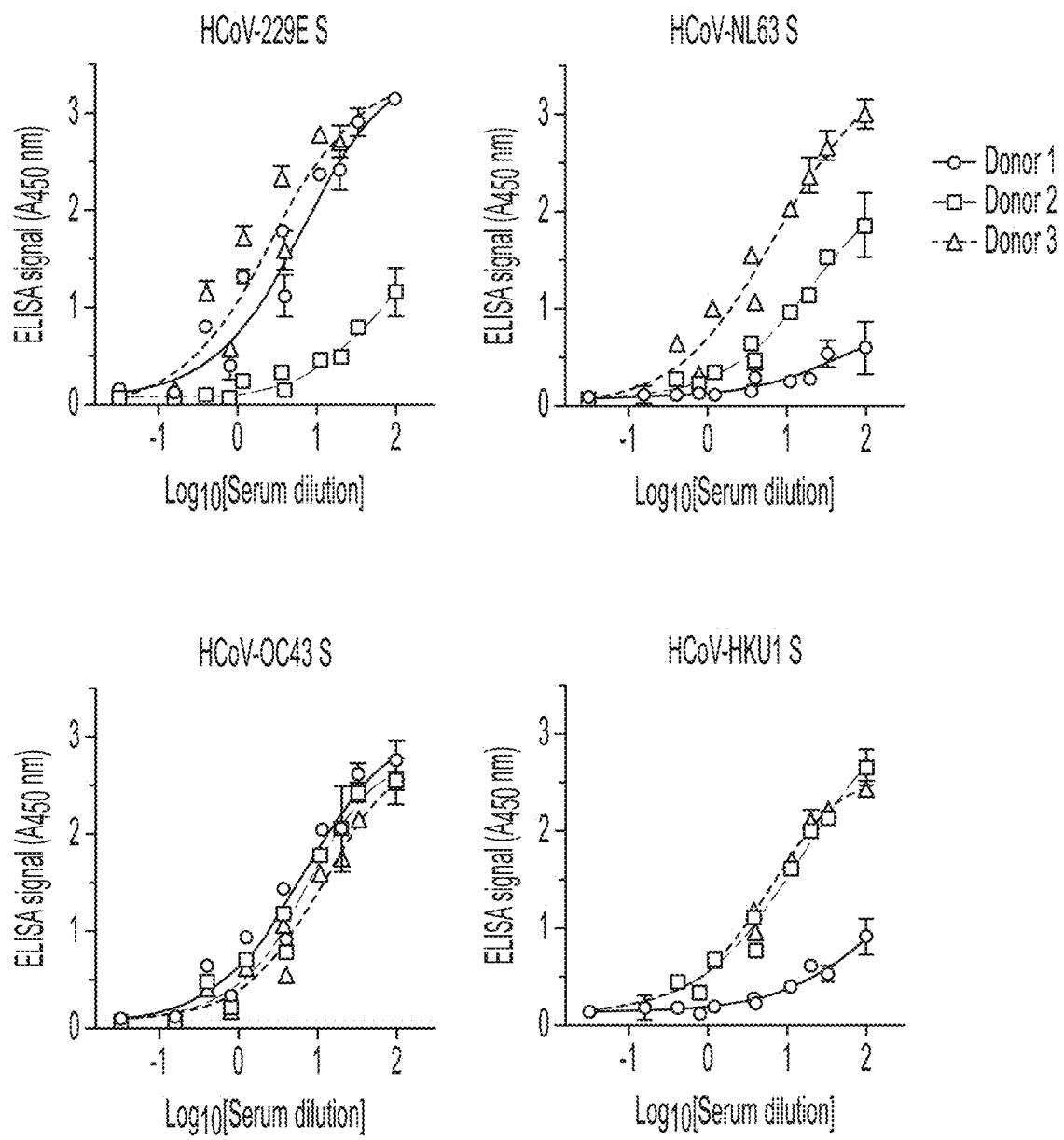
Figure 14L:
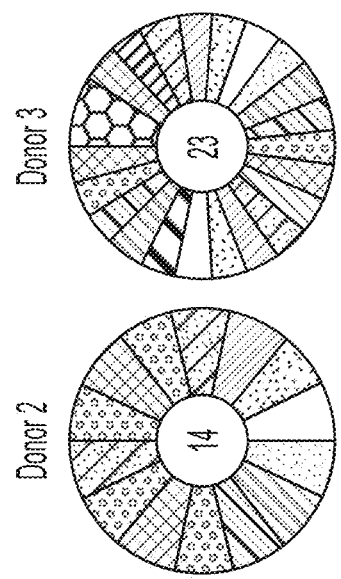
Figure 14K:
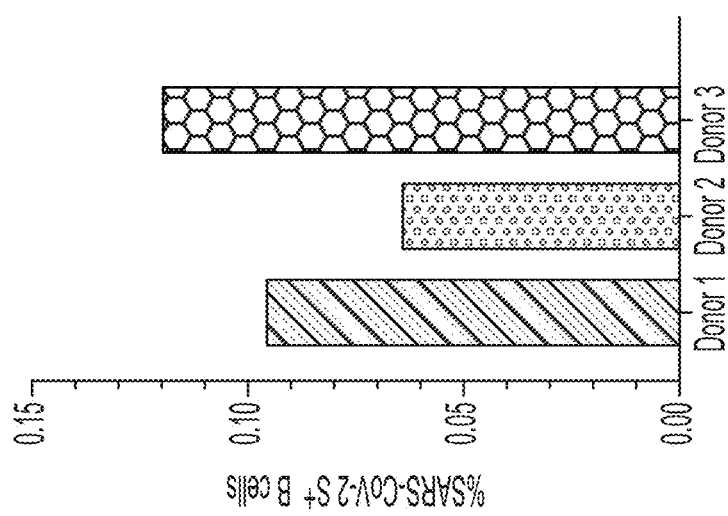

A poly specificity of each antibody was measured as described previously (L. Shehata et al., Affinity Maturation Enhances Antibody Specificity but Compromises Conformational Stability. *Cell reports* 28, 3300-3308 e3304 (2019)). Briefly, soluble membrane protein (SMP) and soluble cytosolic protein (SCP) fractions obtained from Chinese hamster ovary (CHO) cells were biotinylated using NHS-LC-Biotin (Thermo Fisher Scientific Cat #21336). IgGs presented on the surface of yeast were incubated with 1:10 diluted biotinylated CHO cell preparations on ice for 20 minutes. Cells were then washed twice with ice-cold PBS containing 0.1% BSA (PBSF) and incubated in 50 μL of a secondary labelling mix containing ExtrAvidin-R-PE (Sigma-Aldrich), anti-human LC-FITC (Southern Biotech) and propidium iodide) for 15 minutes. The cells were washed twice with PBSF and resuspended in PBSF to be run on a FACSCanto II (BD Biosciences). The mean fluorescence intensity of binding was normalized using control antibodies that display low, medium or high poly specificity to assess the non-specific binding. The results are shown in the tables in FIGS. 13A-13C and the graph in FIG. 13D in comparison with clinical antibodies.

The poly specificity score can be useful, as one or one of many metrics, in ranking the antibodies based on developability. For example, the antibodies can be ranked as clean (below 0.11), low (below 0.33), medium (below 0.66), and high polyspecificity (above 0.66) as in FIG. 13D. In FIGS. 13A-13C, the antibodies were categorized as A when the Score is below 0.10. and as B when the Score is 0.10 or higher. As visualized in FIG. 13D, the vast majority of cross-reactive (i.e., bind to SARS-CoV and SARS-CoV-2) antibodies lacked polyspecificity, demonstrating that the observed broad binding activity is not due to non-specific cross-reactivity.

The results from Examples 2 and 3 are further analyzed and summarized in the graphs in FIG. 14. Over half of the cross-reactive (i.e., bind to SARS-CoV-S and SARS-CoV-2-S) antibodies (89/153) bound with KDApp>10 nM to both SARS-CoV and SARS-CoV-2 S (FIGS. 14A and 14B). As shown in FIG. 14B, over 80% of such SARS-CoV/SARS-CoV-2 cross-reactive antibodies having KDApp values of >10 nM showed reactivity with one or more of the circulating CoVs, a subset of which displayed preferential binding to circulating CoV S proteins, suggesting that these B cells may have been initially induced by seasonal CoV exposure and subsequently activated and expanded by SARS-CoV infection. Alternatively, circulating HCoV infections experienced by this donor after the SARS-CoV infection may have expanded this cross-reactive memory B cell (MBC) pool. Consistent with this hypothesis, the broadly cross-reactive antibodies showed significantly higher levels of somatic hypermutation ("SHM") and clonal expansion compared to the antibodies that only recognized SARS-CoV and SARS-CoV-2, consistent with a recall memory B cell response (FIGS. 14C and 14D). Notably, 72% of the broad binding mAbs utilized VH1-69/VK2-30 germline gene pairing, suggesting germline-mediated recognition of a common antigenic site (FIGS. 14B and 141I). Index sorting analysis revealed that the majority of broad binding antibodies were derived from IgA memory B cells, indicating a mucosal origin, whereas most of the SARS-CoV/SARS-CoV-2 cross-reactive antibodies originated from IgG memory B cells (FIG. 14E).

Although SARS-CoV-2 S-reactive antibodies were identified from all three naïve donors, they displayed lower levels of SHM, clonal expansion, and binding affinities for both SARS-CoV and SARS-CoV-2 S compared to the cross-reactive antibodies identified from the convalescent SARS donor (FIGS. 14F and 14G). Altogether, these results suggest that SARS-CoV infection likely led to the activation and expansion of pre-existing cross-reactive memory B cells induced by circulating CoVs or vice versa.

To investigate whether the above results were due to an original antigenic sin ("OAS") phenomenon, or instead, as was hoped, due to avid binding of circulating HCoV-specific B cell receptors to the SARS-CoV-2 S tetramers used for cell sorting, whether similarly broadly binding antibodies were also present in sarbecovirus-naïve donors that had been exposed to endemic HCoVs by ELISA was assessed. Peripheral blood mononuclear cell (PBMC) samples were obtained from three healthy adult donors with serological evidence of circulating HCoV exposure and no history of SARS-CoV or SARS-CoV-2 infection and stained the corresponding B cells with a fluorescently labeled SARS-CoV-2 S probe (FIGS. 14I and 14J). Flow cytometric analysis revealed that between 0.06-0.1% of total B cells in the three naïve donors displayed SARS-CoV-2 reactivity (FIG. 14K). Over 350 SARS-CoV-2-reactive MBCs were sorted and amplified by single-cell RT-PCR, and 141 VH/VL pairs were cloned and expressed as full-length IgGs. Although a limited number of SARS-CoV-2 S binding antibodies were identified from all three naïve donors, they displayed significantly lower levels of SHM, clonal expansion, and binding affinities for both SARS-CoV and SARS-CoV-2 S compared to the cross-reactive antibodies identified from the convalescent SARS donor (FIGS. 14F and 14G and FIG. 14L). Altogether, these results suggest that SARS-CoV infection likely led to the activation and expansion of pre-existing cross-reactive MBCs induced by circulating HCoV exposure.

Example 4: Epitope Mapping

Epitope mapping was performed using different subunit and domain constructs of SARS-CoV-2-S using the Forte bio kit and yeast-based competition assays. Due to the inherent technical challenges associated with measuring binding of certain antibodies to monomeric proteins, these studies were restricted to the 65 binders with $K_D^{APPs}$<10 nM to SARS-CoV-2 (FIG. "7).

The domain/subunit used for the binding studies were the 51 subunit, S2 subunit, the RBD, and NTD and for the binding to 51 and NTD, monovalent binding and bivalent (AVID") binding were both measured.

Figures 21E, 21F:
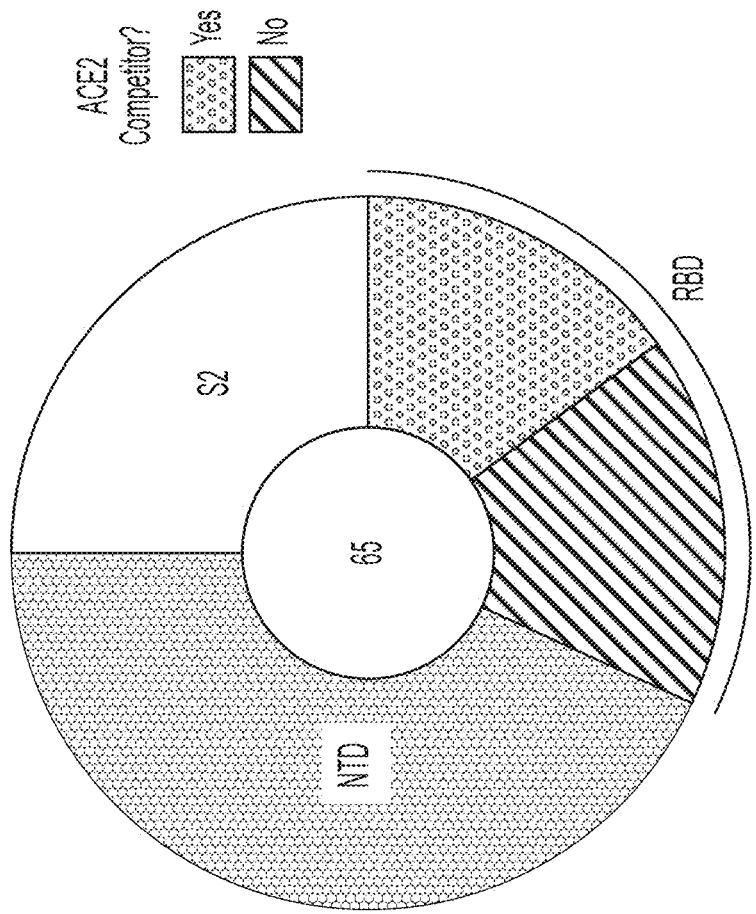

The results in FIGS. 15-18 are further summarized in FIG. 19 and FIG. 21F. Again the antibodies with a binding response value of 0.1 or higher were considered as binders (shown as "Yes"). Also again the antibodies with a binding response value such as 0.099 or 0.098 that can be round up to 0.1 were also considered as binders and shown as "Yes". Antibodies with a binding response value of <0.1 were considered to be non-binders (shown as "Non").

As shown in FIGS. 15-19 and 21F, 75% of the antibodies recognized epitopes within 51, whereas the remaining 25% bound to epitopes within S2, and among 49 S1-directed antibodies 21 (43%) and 28 (57%) recognized the RBD and NTD, respectively.

For the competition studies, the competition of each antibody with recombinant human ACE2 ("hACE2") and with a commercial antibody CR3022, which targets a conserved epitope outside of the receptor binding site, was tested (M. Yuan et al., A highly conserved cryptic epitope in the receptor-binding domains of SARS-CoV-2 and SARS-CoV. Science, (2020)).

The results are shown in FIGS. 21A-21E. As shown six of the antibodies competed only with hACE2, three competed only with CR3022, four competed with both hACE2 and CR3022, and seven did not compete with either hACE2 or CR3022.

Example 5: Cell Binding Assays

HEK-293 cells were transiently transfected with a plasmid encoding the S protein of SARS-CoV or of SARS-CoV-2 or with an empty plasmid, using the transfection reagent PEI. Antibodies were incubated with the HEK-293 cells engineered to express SARS-CoV-2-S or the HEK-293 cells transfected with an empty plasmid ("wild type" cells or "WT" cells), and the binding was measured. The fold binding to the S protein-expressing cells over the WT cells and the EC50 [nM] values were calculated. The results for SARS-CoV-2-S cell binding are shown in FIGS. 20A-20E and the results for SARS-CoV-S cell binding are shown in FIG. 20F.

Example 6: Micro-Titer Neutralization Assays

To evaluate the neutralization potency of the SARS-CoV/SARS-CoV-2 cross-reactive antibodies, neutralization assays were performed using both VSV- and murine leukemia virus (MLV)-based pseudotype systems as well as authentic viruses of SARS-CoV and SARS-CoV-2. Due to the large number of antibodies, initial neutralization screening was performed in an authentic virus assay using a single concentration of purified IgG.

6-1: Authentic SARS-CoV and SARS-CoV-2 Neutralization Assay

Vero E6 cells were inoculated with SARS-CoV-2/MT020880.1 or SARS-CoV/Urbani at an MOI=0.01 and incubated at 37° C./5% CO2/80% humidity. At 50 hours post-infection, cells were frozen at −80° C. for 1 hour, allowed to thaw at room temperature, and supernatants were collected and clarified by centrifugation at ~2500×g for 10 minutes. Clarified supernatant was aliquoted and stored at −80° C. Sequencing data for the SARS-CoV-2 virus stock indicated a single mutation in the spike glycoprotein (H655 to Y) relative to Washington state isolate MT020880.1. Sequencing data is not available for the SARS-CoV stock.

A pre-titrated amount of authentic SARS-CoV-2/MT020880.1 or SARS-CoV/Urbani, at final multiplicity of infection of 0.4 and 0.2., respectively, was incubated with serial dilutions of monoclonal antibodies for 1 h at room temperature. The antibody-virus mixture was applied to monolayers of Vero-E6 cells in a 96-well plate and incubated for 1 hour at 37° C. in a humidified incubator. Infection media was then removed and cells were washed once with 1×PBS, followed by addition of fresh cell culture media. Culture media was removed 24 hours post infection and cells were washed once with 1× PBS. PBS was removed and plates were submerged in formalin fixing solution, then permeabilized with 0.2% Triton-X for 10 minutes at room temp and treated with blocking solution. Infected cells were detected using a cross-reactive primary detection antibody recognizing SARS-CoV and SARS-CoV-2 nucleocapsid protein (Sino Biological) 5 following staining with secondary detection antibody (goat a rabbit) conjugated to AlexaFluor 488. Infected cells were enumerated using Operetta high content imaging instrument and data analysis was performed using the Harmony software (Perkin Elmer).

6-2: rVSV-SARS-CoV-2 Neutralization Assay

A recombinant vesicular stomatitis virus (rVSV) expressing an eGFP reporter and encoding the SARS-CoV-2 spike protein gene (SEQ ID NO: 6) in place of its native glycoprotein is generated by plasmid-based rescue as described previously (Whelan et al., 1995; PMID: 7667300 and Kleinfelter et al., 2015; PMID: 26126854). The identity of the generated virus is confirmed by Sanger sequencing of the spike protein encoding gene after RT-PCR amplification.

A pre-titrated amount of rVSV-SARS2 S virus is incubated with serial dilutions of monoclonal antibodies for 1 hr at room temperature. The antibody-virus mixture is applied to monolayers of Huh7.5.1 cells in a 384-well plate. Following overnight incubation, eGFP-positive virus-infected cells are enumerated using a Cytation-5 imager (Biotek) and analyzed with the onboard Gen5 software.

6-3: SARS-CoV-MLV and SARS-CoV-2 MLV Pseudo Viral Particle Neutralization Assay To generate pseudovirus, SARS-CoV (AAP13567) and SARS-CoV2 (NC_045512) spike genes (codon optimized for mammalian expression) were synthesized (IDT) with 18 and 28 amino acid c-terminal deletions respectively and cloned into pCDNA3.3 (ThermoFisher). A luciferase reporter gene plasmid (addgene #18760) was modified to replace the IRES with a CMV promoter. These plasmids along with MLV gag/pol (addgene #14887) were purified using Endo-Free plasmid maxi kits (Qiagen, #12362). Under sterile conditions, these plasmids were co-transfected into HEK293T cells using Lipofectamine 2000 (ThermoFischer Scientific, 11668019) according to the manufacturer's directions to produce single-round of infection competent pseudoviruses. 0.5 ug SARS-CoV-2 or 1 ug SARS-CoV-1 S, 2 ug gag/pol and 2 ug MLV luciferase was used per well of a 6-well plate. The media was changed 16 hours post transfection. The supernatant containing SARS S-pseudo-typed viral particles was collected 48h post transfection, aliquoted, and frozen at −80° C. for the neutralization assay.
n
SARS-CoV-1 and SARS-CoV-2 neutralization by monoclonal antibodies was assessed using a Murine Leukemia Pseudovirus assay described in (ref). Briefly, SARS Spike (S) protein pseudotyped Murine Leukemia Virus (MLV) containing a firefly luciferase reporter gene was titrated with various mAbs and subsequently added to hACE2-expressing Hela cells where infection was monitored using a luminescence assay.

The neutralization assay was performed as previously described with minor modifications (PMID:24291345). In sterile white 96-well half-area plates (Corning, #3688), 25 µl of SARS1 or SARS2 pseudotyped MLV vector was immediately mixed with 2510 of serially diluted (5× using media) mAbs and incubated for one hour at 37° C. to allow for antibody neutralization of the pseudotyped virus. 10,000 HeLa-hACE2 cells/well (in 50 ul of media containing 20 µg/ml Dextran) were directly added to the antibody virus mixture. Plates were incubated at 37° C. for 42 to 48 h. Following the infection, HeLa-hACE2 cells were lysed using 1× luciferase lysis buffer (25 mM Gly-Gly pH 7.8, 15 mM MgSO4, 4 mM EGTA, 1% Triton X-100). Luciferase intensity was then read on a Luminometer with luciferase substrate according to the manufacturer's instructions (Promega, PR-E2620). Percentage of neutralization was calculated using the following equation.

$$100 * \left(1 - \frac{RULs \text{ of sample} - \text{Average } RULs \text{ of Background}}{\text{Average of } RULs \text{ of Virus only control} - \text{Average } RULs \text{ of Background}}\right)$$

Figure 22B:
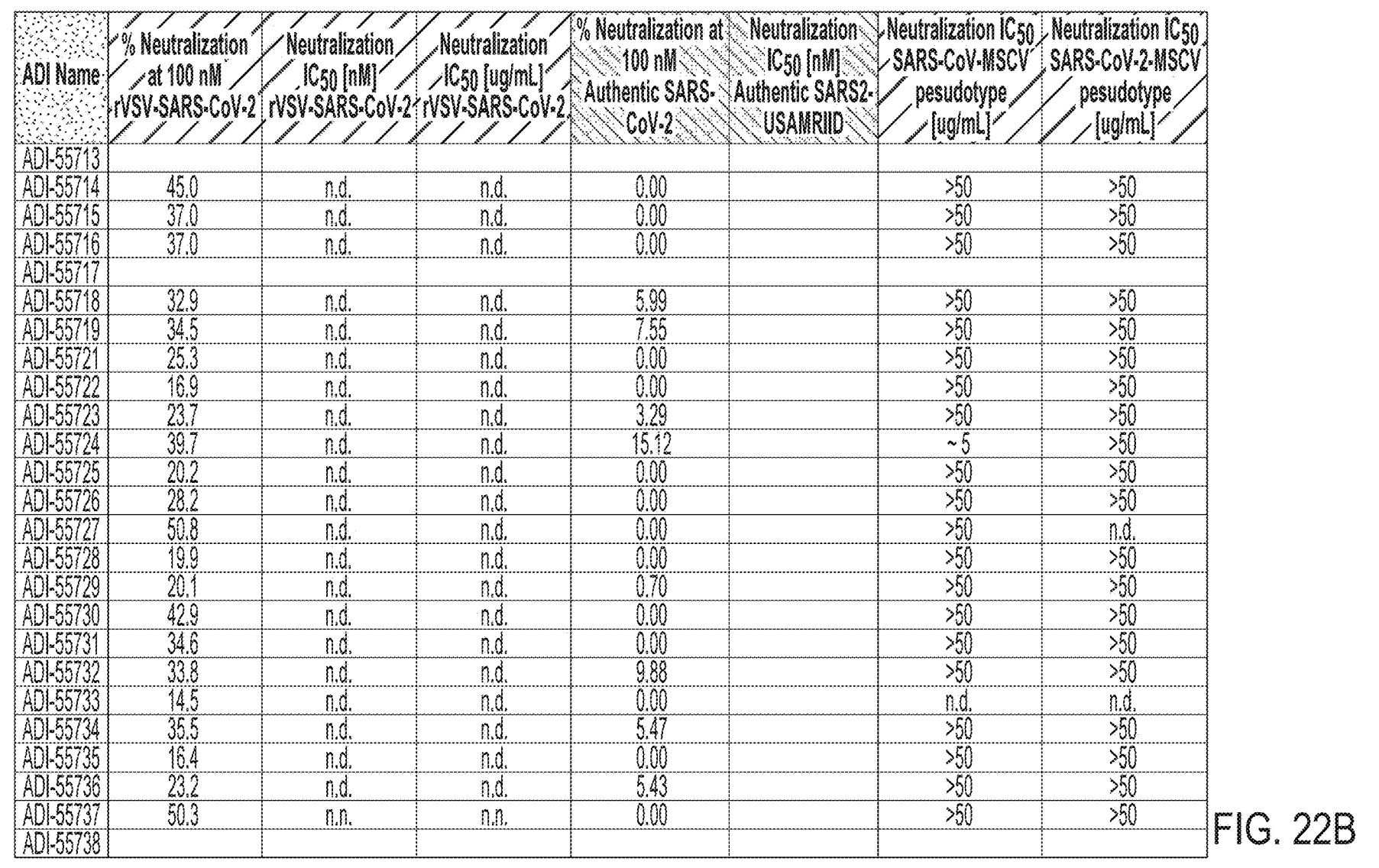
Figure 23A:
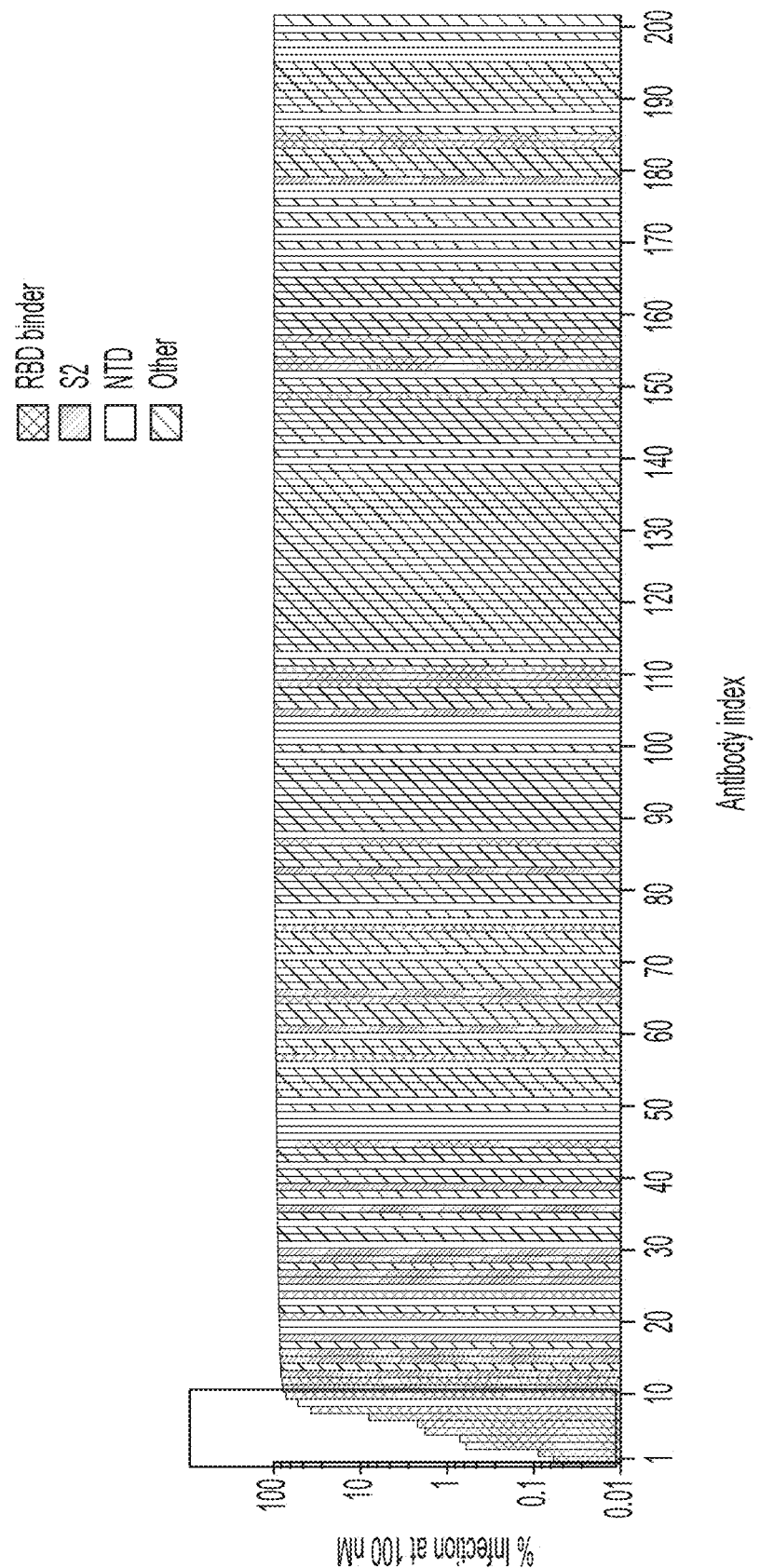
FIGS. 23A-23E contain analyses of the relationship between the binding epitope and the neutralizability of the antibodies.
Figure 23B:
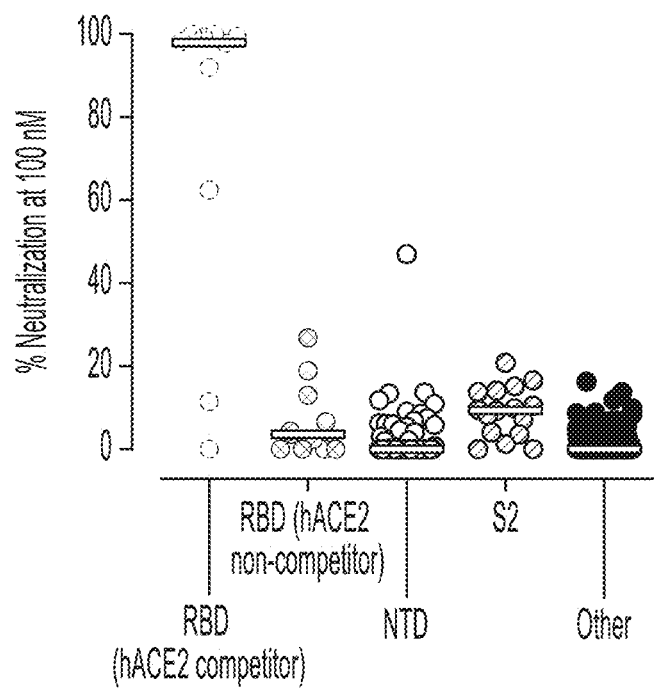
Figure 23C:
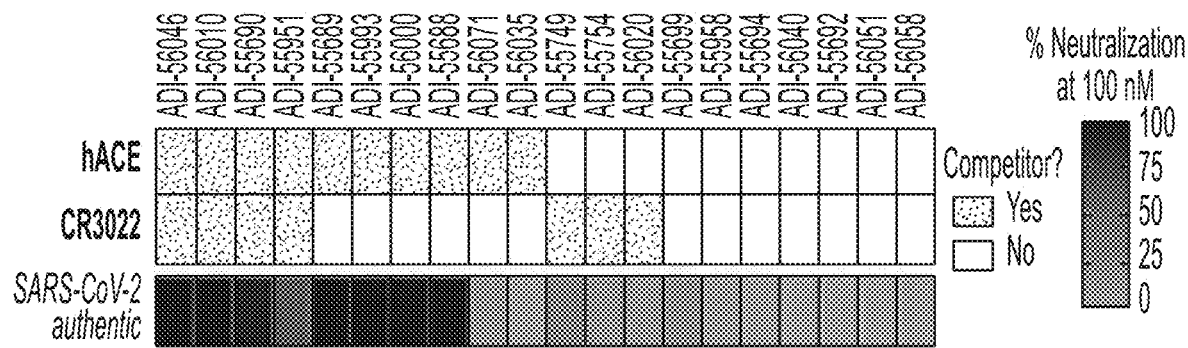
Figure 23D:
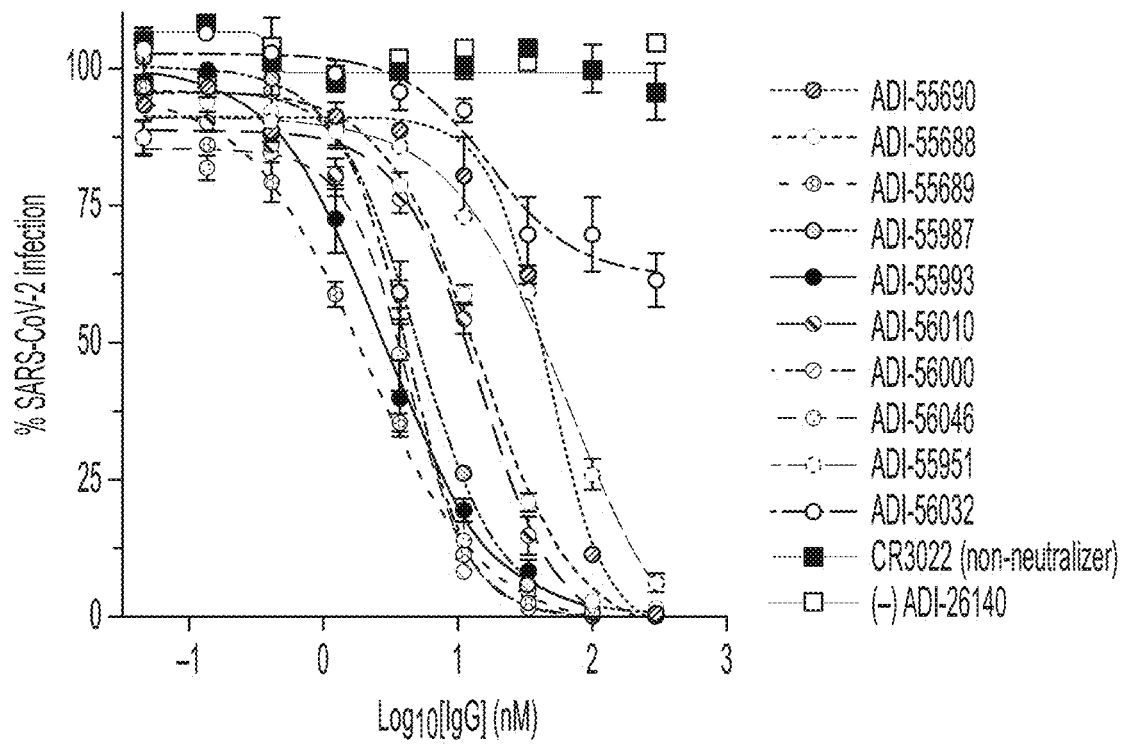
Figure 23E:
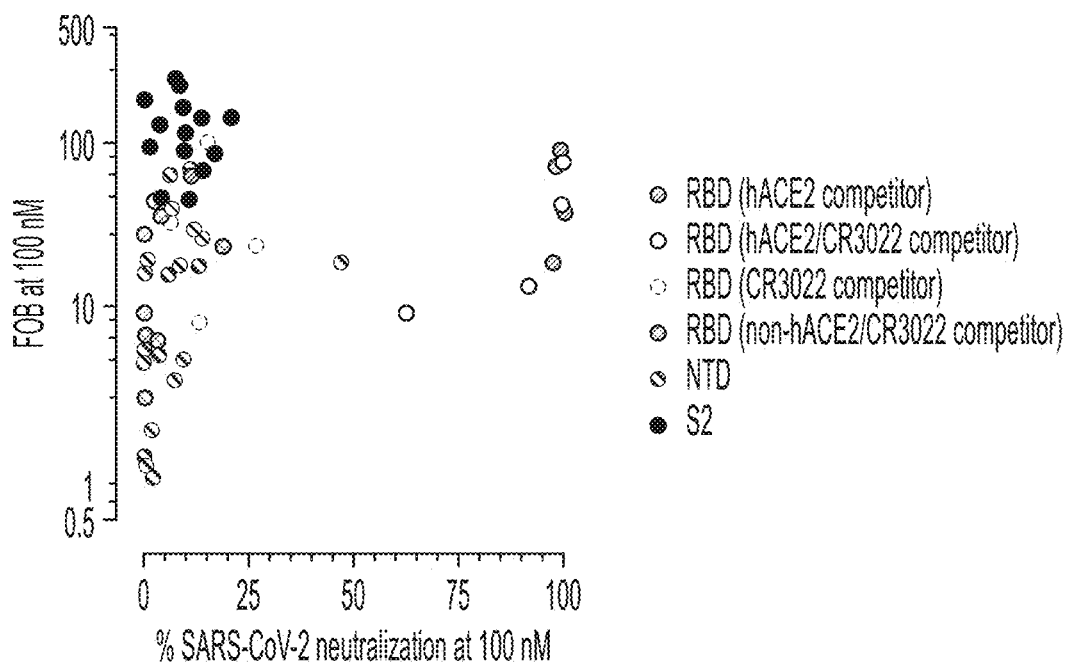
Figure 23F:
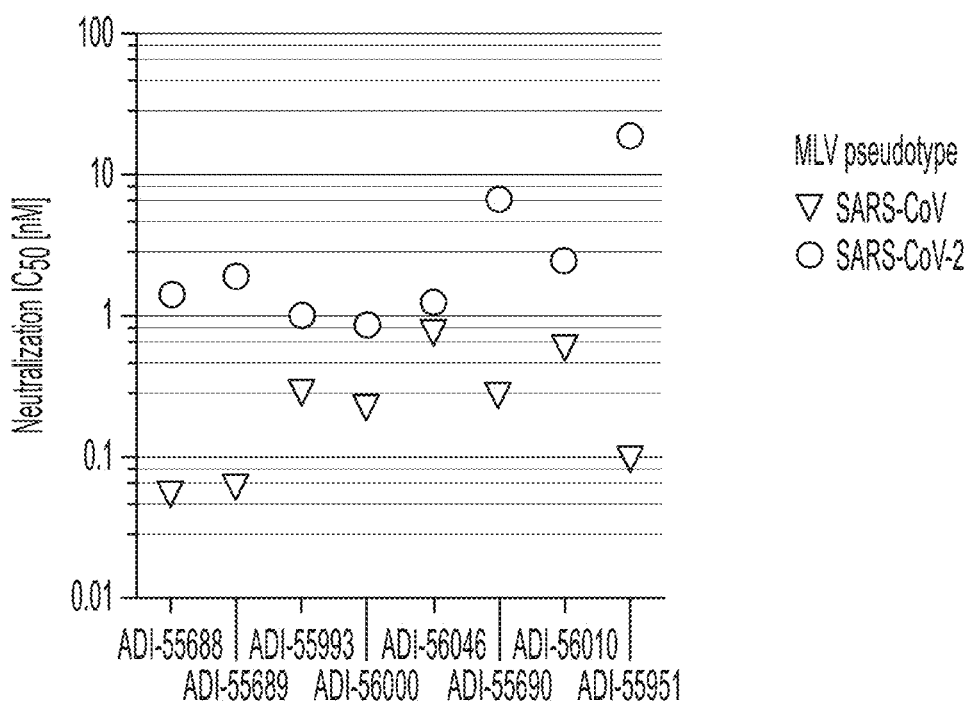
FIGS. 23F-23G show the results from the neutralization assays on selected antibodies in Example 6.
Figure 23G:
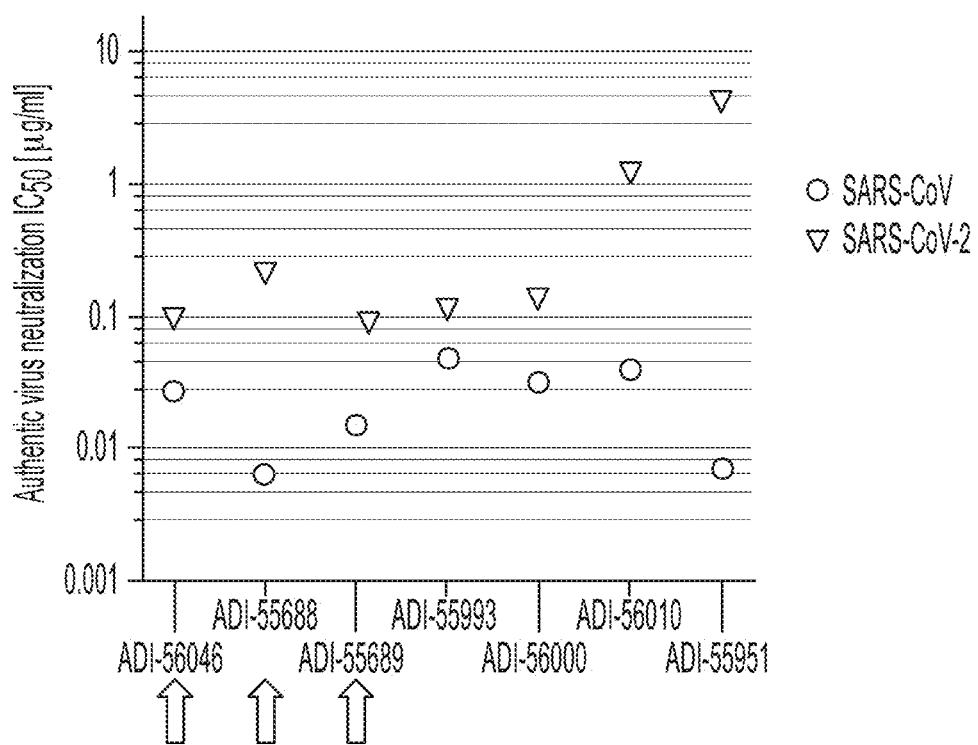

The results from 6-1 through 6-3 are shown in FIG. 22, FIGS. 23F and 23G show neutralization results on selected antibodies.

Also, the authentic virus neutralization results were analyzed together with the results from the epitope analysis from Example 4. As shown in FIGS. 23A and 23B, nine out of 202 antibodies showed >40% neutralization at 100 nM using the authentic virus system, and eight of the nine antibodies bind to the RBD (FIG. 23A) and compete with hACE2 (FIG. 23B) and one of the nine antibodies bind to the NTD (FIG. 23A). Of the nine, seven antibodies showed >90% neutralization (FIGS. 22 and 23A). All seven of these neutralizing antibodies bind to the RBD and compete with hACE2 (FIGS. 22, 23A, and 23B). Of the eight RBD-directed antibodies, four bound to epitopes overlapping both hACE2 and CR3022 (FIG. 30D) and the other four recognized epitopes only overlapping that of hACE2 (FIG. 23C), suggesting the existence of at least two overlapping but distinct neutralizing epitopes within the RBD. None of the antibodies that bind to the RBD, but which do not compete with hACE2, exhibited neutralization at 100 nM (FIG. 23C).

Titration studies further demonstrated that the nAbs displayed IC50's ranging from 0.6-20 µg/ml against authentic SARS-CoV-2, and significantly, none of the antibodies left an un-neutralized fraction of virus (FIG. 23D).

Interestingly, little to no correlation was observed between binding affinity for cell surface S and neutralizing activity (FIG. 23E). For example, all of the S2-directed antibodies and a subset of NTD-directed antibodies bound with high affinity to both recombinant and cell surface S, but none of these antibodies displayed significant neutralizing activity. Similarly, the RBD-directed antibodies targeting epitopes outside of the hACE2 binding site showed little to no neutralizing activity, despite binding with similar or even higher affinity to cell surface S compared to the hACE2 competitor antibodies.

Figure 26:
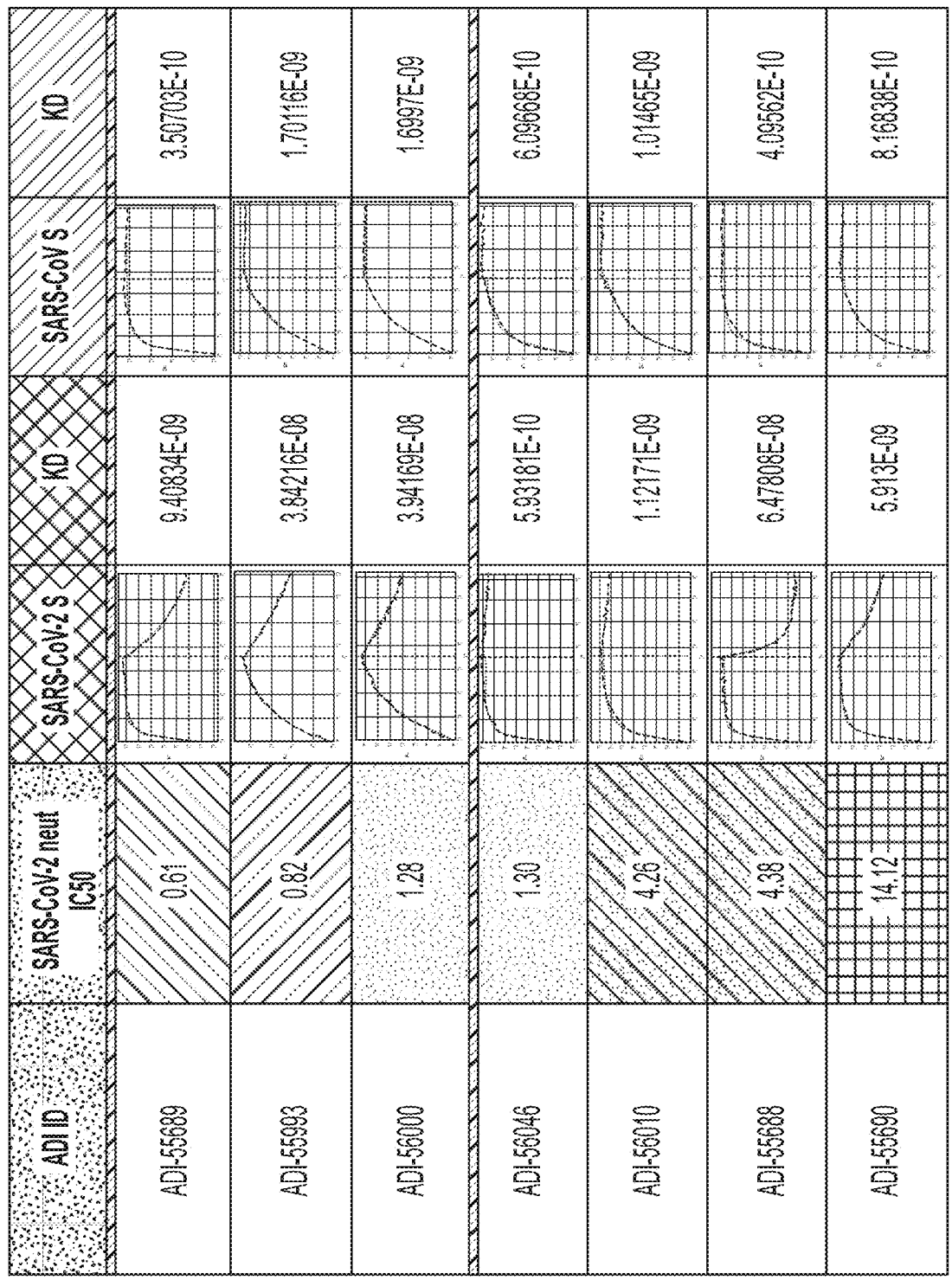
FIG. 26 provides a summary of authentic SARS-CoV-2 neutralization IC50 [ug/mL] values and of affinities ($K_D$ values) to SARS-CoV-S and SARS-CoV-2-S, for seven selected antibodies. Based on their binding properties some of these antibodies were selected for further affinity maturation.

The neutralization data from using different viral systems for the nine antibodies that showed >40% neutralization of authentic viruses are further summarized in FIG. 25. The IC50 values and KD values of seven antibodies that showed neutralization using two or more viral/pseudoviral systems in FIG. 25 are summarized in FIG. 26. Based on their binding and neutralization properties these antibodies were selected as being ideal candidates for further affinity maturation.

Figure 24:
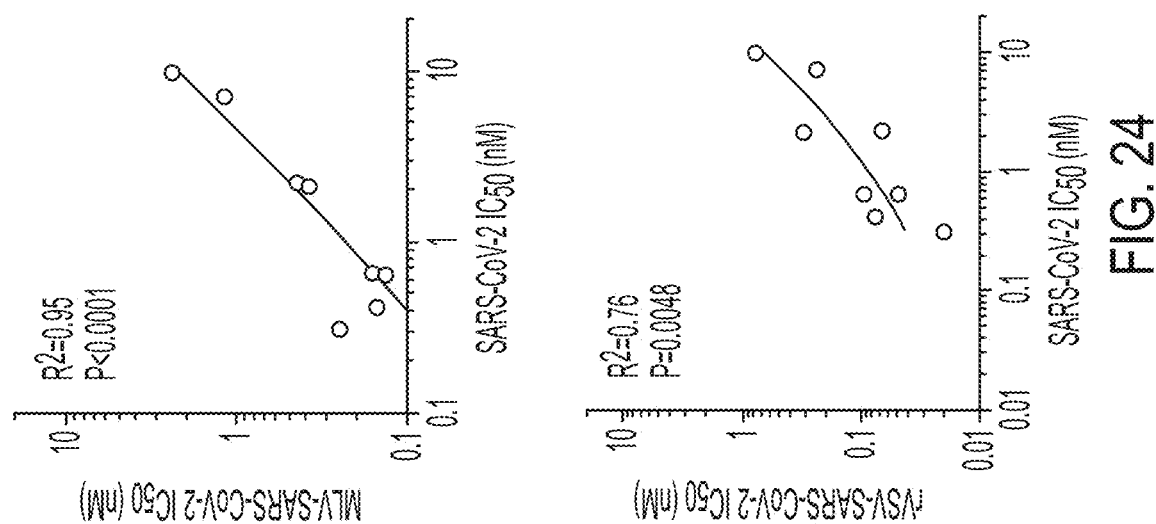
FIG. 24 provides graphs showing correlation between authentic SARS-CoV-2 neutralization IC50 using Vero E6 target cells and (top) MLV-SARS-CoV-2 pseudovirus neutralization IC50 using HeLa-ACE2 target cells or (bottom) VSV-SARS-CoV-2 neutralization IC50 using Vero E6 target cells. R2 values were calculated using linear regression.

Neutralization of MLV pseudotype SARS-CoV and SARS-CoV-2 by eight antibodies are shown in FIG. 23F. All eight antibodies neutralized both SARS-CoV and SARS-CoV-2 pseudo-MLV. Neutralization of authentic SARS-CoV and SARS-CoV-2 by seven antibodies are shown in FIG. 23G. All seven antibodies neutralized both SARS-CoV and SARS-CoV-2. ADI-55688, ADI-55689, ADI-55993, and ADI-56046 (arrowed) were further subjected to affinity maturation in Example 12. FIG. 24 shows the neutralization results obtained using the pseudo system (MLV or rVSV) corelate well with the results obtained using the authentic viruses.

Example 7: Cluster Analysis of Antibodies Based on VH CDR3

A clustering analysis on antibodies assigned with BD Index Numbers 1-71 was performed based on the VH CDR3 amino acid sequences using the parameters below:
1) Levenshtein distance <=3
2) Aggressive clustering to merge clusters
3) Reduced alphabet: (AST), (G), (P), (FWY), (ILVMC), (DE), (NQH), (RK)

Figure 28B:
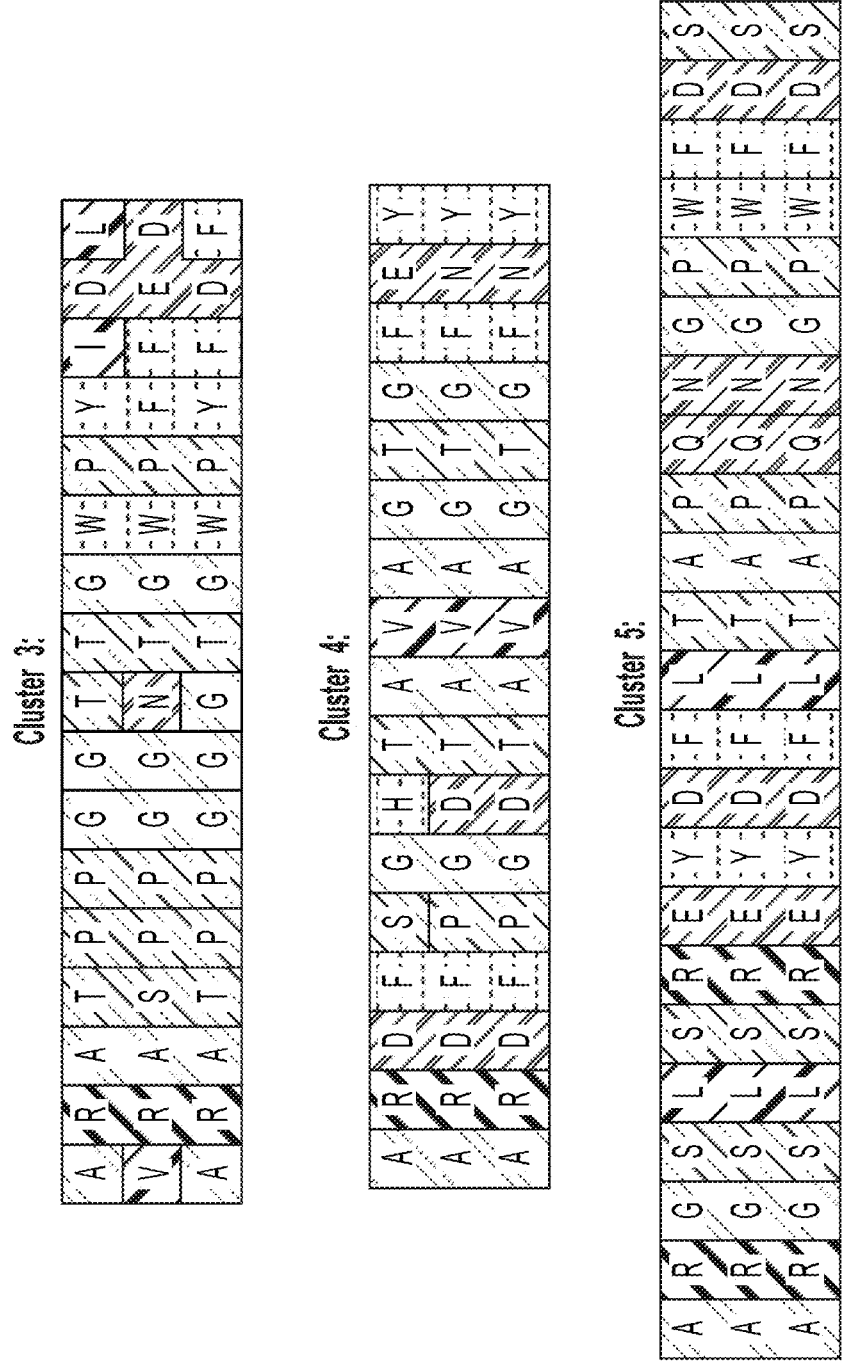

FIGS. 27A-27C provide clusters based on VH CDR3. FIGS. 28A-28B provides sample plots for the clusters containing more than 2 antibodies (Clusters 1 through 5).

Antibodies that are classified in Cluster 1 are ADI-55702, ADI-55704, ADI-55706, ADI-55723, ADI-55725, ADI-55726, ADI-55728, ADI-55731, ADI-55739, ADI-55741, ADI-55743, ADI-55745, and ADI-55748. Antibodies that are classified in Cluster 2 are ADI-55700, ADI-55705, ADI-55712, ADI-55717, ADI-55736, ADI-55742, and ADI-55747. Antibodies that are classified in Cluster 3 are ADI-55695, ADI-55698, and ADI-55714. Antibodies that are classified in Cluster 4 are ADI-55688, ADI-55691, and ADI-55693. Antibodies that are classified in Cluster 5 are ADI-55708, ADI-55709, and ADI-55719. Among these antibodies, ADI-55700, ADI-55688, ADI-55708, ADI-55709, and ADI-55719 are those that were determined to be cross-reactive. Particularly, the results from Example 2 and Example 6 were compared and it was discovered that Cluster 5 antibodies, ADI-55708, ADI-55709, and ADI-55719, are all cross-reactive antibodies, and interestingly, share the identical VH CDR3 sequence, which is ARGSLSREYDFLTAPQNGPWFDS (SEQ ID NO: 2108, 2208, or 3208) suggesting that there is a structure-feature relationship between this particular VH CDR3 sequence and the ability of the antibodies containing this VH CDR3 polypeptide to cross-react with SARS-CoV-S and SARS-CoV-2-S. Moreover, since these three antibodies also share the same VH CDR1 as well, it is further possible that the VH CDR1 may also contribute to the structure-feature relationship, i.e., the ability to cross-react with SARS-CoV-S and SARS-CoV-2-S.

Example 8: FRNT Assay

For SARS CoV or SARS-CoV-2 spike protein binding ELISAs, 96-well plates (Corning; Cat #3690) were coated with 5 μg/ml of SARS CoV or SARS-CoV-2 spike protein diluted in PBS and incubated overnight at 4° C. Wells were washed and then blocked with 5% non-fat dried milk (NFDM) in PBS for 1 hour at 37° C. Wells were washed 3 times with PBS and serial dilutions of human plasm in 5% NFDM-PBS were added and incubated for 1 hour at 37° C. Plates were then washed 3 times with PBS and secondary cross-adsorbed anti-human IgG-HRP (Thermo Fisher Scientific; cat #31413) or anti-human-IgM (Sigma Aldrich; cat #AP114P) detection antibodies were added at 1:8000 dilution in 5% NFDM-PBS for 1 hour at 37° C. After washing 3 times with PBS detection reagent was added per manufacturer recommendations (Thermo Scientific; Cat #34029) and absorbance was measures at 450 nM wavelength using a Spectramax microplate Reader (Molecular Devices).

Example 9: In Vivo Efficacy

Therapeutic and/or Prophylactic Efficacy

Test animals, preferably mammals such as mice, rats, rabbits, pigs, or monkeys, will be split in multiple groups. An antibody or fragment thereof of the present disclosure will be administered to at least one group. At least one group will not receive such antibody or fragment thereof. The animals will then be infected with coronavirus (SARS-CoV, SARS-CoV-2, MERS-CoV, or a seasonal CoV). Alternatively, the antibody or fragment thereof may be administered before the infection with CoV. The antibody or fragment thereof may be given intravenously, intraperitoneally, intranasally, or via any other appropriate route.

The body weight of each animal will be monitored. Symptoms such as fever or mobility may also be monitored. Periodically, samples such as serum will be harvested and the viral load will be measured. Survival will be tracked Animals may be sacrificed based on the pre-determined cutoff value of the body weight and/or viremia and/or the behavior and/or symptom(s).

Example 10: Prediction of CoV Vaccine Efficacy

Some of the antibodies of the present disclosure neutralize CoV ("nAb"). Some of the antibodies do not neutralize CoV ("non-nAb"). The use of these antibodies for predicting whether a given CoV vaccine composition will elicit protective immune responses, such as neutralizing antibodies when the vaccine is administered to a subject, is envisioned. This will be achieved by quantifying the binding of the vaccine composition with nAb and/or non-Ab and determining whether the composition binds to, binds sufficiently to, or binds more to nAbs.

Different vaccine compositions may be compared, perhaps for the screening purposes, to determine which vaccine is predicted to elicit more or better protective immune responses such as neutralizing antibodies. For example, this may be done by preparing a panel of different nAb(s) and non-nAb(s) and test which vaccine composition binds more to the nAb(s) than to the non-nAb(s). Vaccine compositions that bind more to the nAb(s) would be predicted to be more effective in eliciting protective immune responses.

Furthermore, CoV-S is a highly glycosylated protein, and therefore the glycosylation can vary depending on how the S protein is prepared. For example, the type of cells, the expression method and/or conditions, purification method and/or conditions, or even storage can affect the glycosylation. All these factors can affect whether a putative vaccine contains at least one epitope to which a vaccinated individual will elicit an immune response against which will be sufficient in order to mount a protective immunity. It is anticipated that the antibodies may aid in determining whether a putative vaccine expresses a CoV-S protein having the appropriate glycosylation in order to elicit neutralizing antibodies.

Broadly protective vaccines against known and pre-emergent coronaviruses are urgently needed. When the purpose of vaccine is to induce immune responses that are broadly protective against CoVs that infect humans, one may want to test whether the vaccine composition binds to antibodies that bind to a broad CoV species. When the purpose of vaccine is to induce immune responses mainly against SARS-CoV and/or SARS-CoV-2, one may want to test whether the vaccine composition binds to antibodies that bind to SARS-CoV and/or SARS-CoV-2.

For this purpose of vaccine effectiveness prediction, a kit that comprises at least one antibody and an instruction on how to use such an antibody is envisioned. The instruction may teach how to perform a vaccine efficacy prediction study.

Such a kit may also be for use in diagnosing CoV infection, detection of the presence of CoV in a subject or a specimen from a subject, treating CoV infection, or preventing CoV infection.

Example 11: Anti-CoV-S Antibody Screening

Additional antibodies or fragments thereof may be screening or discovered using the antibody sequences disclosed herein. For example, one or more antibodies comprising at least one of the six CDRs of any one of the antibodies disclosed herein may be first prepared. Then such antibody(ies) may be tested whether to provide one or more of the flowing features: (i) binds to the S protein of a CoV; (ii) binds to the 51 subunit of CoV-S; (iii) binds to the RBD of CoV-S; (iv) binds to the NTD of CoV-S; (v) binds to the ACE2-binding motif of CoV-S; (vi) competes with ACE2 such as hACE2; (vii) competes with the antibody CR3022; (viii) neutralizes one or more of SARS-CoV, SARS-CoV-2, MERS-CoV, HCoV-229E, HCoV-HKU1, HCoV-NL63, or HCoV-0K43 or variants thereof; (iv) neutralizes a pseudovirus of one or more of SARS-CoV, SARS-CoV-2, MERS-CoV, HCoV-229E, HCoV-HKU1, HCoV-NL63, or HCoV- OK43 or variants thereof; or (x) prevents or treats CoV infection in vivo. For such testing, the method to be used is not limited to the method disclosed in the current application but also may be any other test methods and/or techniques of the field may be used.

It is noted that not only neutralizing antibodies but also non-neutralizing antibodies may be useful for preventing and/or treating CoV infection. For example, such non-neutralizing antibodies can still mediate antibody dependent cell-mediated cytotoxicity ("ADCC") and/or complement-dependent cytotoxicity ("CDC"), for example if the antibody binds to a CoV on the cell surface. Furthermore, such non-neutralizing antibody or antigen binding fragment thereof may be used as part of an ADC or a CAR construct, because it is not necessarily the antigen-binding domain that provides the cytotoxicity of an ADC or a CAR; rather it may involve the drug that is conjugated or a host cell mechanism. Accordingly, the antigen-binding domain may only need to bind to CoV and does not by itself necessarily have to possess neutralization capabilities. Moreover, non-neutralizing antibodies may also be used for detecting CoV in a sample or to be used in predicting vaccine effectiveness as described in Example 10.

Example 12: Affinity Maturation of SARS-CoV-2 Neutralizing Antibodies

ADI-57983, ADI-57978, and ADI-56868 were obtained by affinity maturation of ADI-55689; ADI-55688; and ADI-56046, respectively.

Affinity maturation of antibodies was performed by introducing diversities into the heavy chain and light chain variable regions as described below.

VH CDR1, VH CDR2 and VH CDR3 selection: Forward priming oligos were ordered from IDT with variegation in the VH CDR1, VH CDR2, and VH CDR3 for heavy chain diversification. FR1-FR4 oligos containing homology to the CDRs above were ordered in the reverse priming direction for the assembly and amplification of the entire heavy chain variable regions via PCR. The heavy chain variable regions (FR1-FR4) were transformed into yeast containing the light chain plasmid of the parent. With the library diversity of $1 \times 10^7$, selections were performed with two rounds of FACS, sorting for the highest affinity biotinylated SARS-CoV-2 spike protein binders using antigen titration.

VL CDR1, VL CDR2 and VL CDR3 selection: VL CDR1, VL CDR2, and VL CDR3 diversification was obtained by ordering forward priming oligos with variegation in each CDR. FR1-FR4 oligos containing homology to the CDRs above were ordered in the reverse priming direction for the assembly and amplification of the entire light chain variable regions via PCR. The light chain variable regions (FR1-FR4) were transformed into yeast containing the heavy chain plasmid of the parent. With the library diversity of $1 \times 10^6$, selections were performed with two rounds of FACS. Affinity pressure was applied by titrating the biotinylated SARS-CoV-2 spike protein.

Figure 30B:
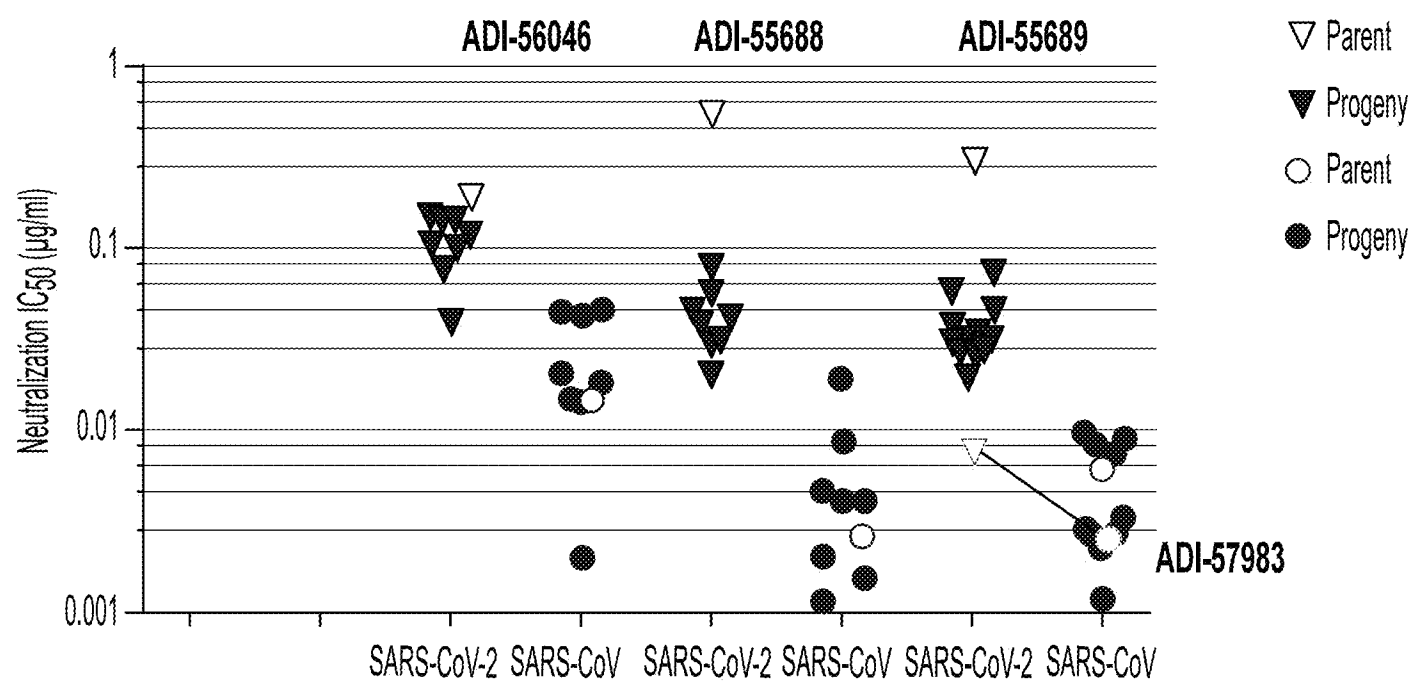
Figure 30C:
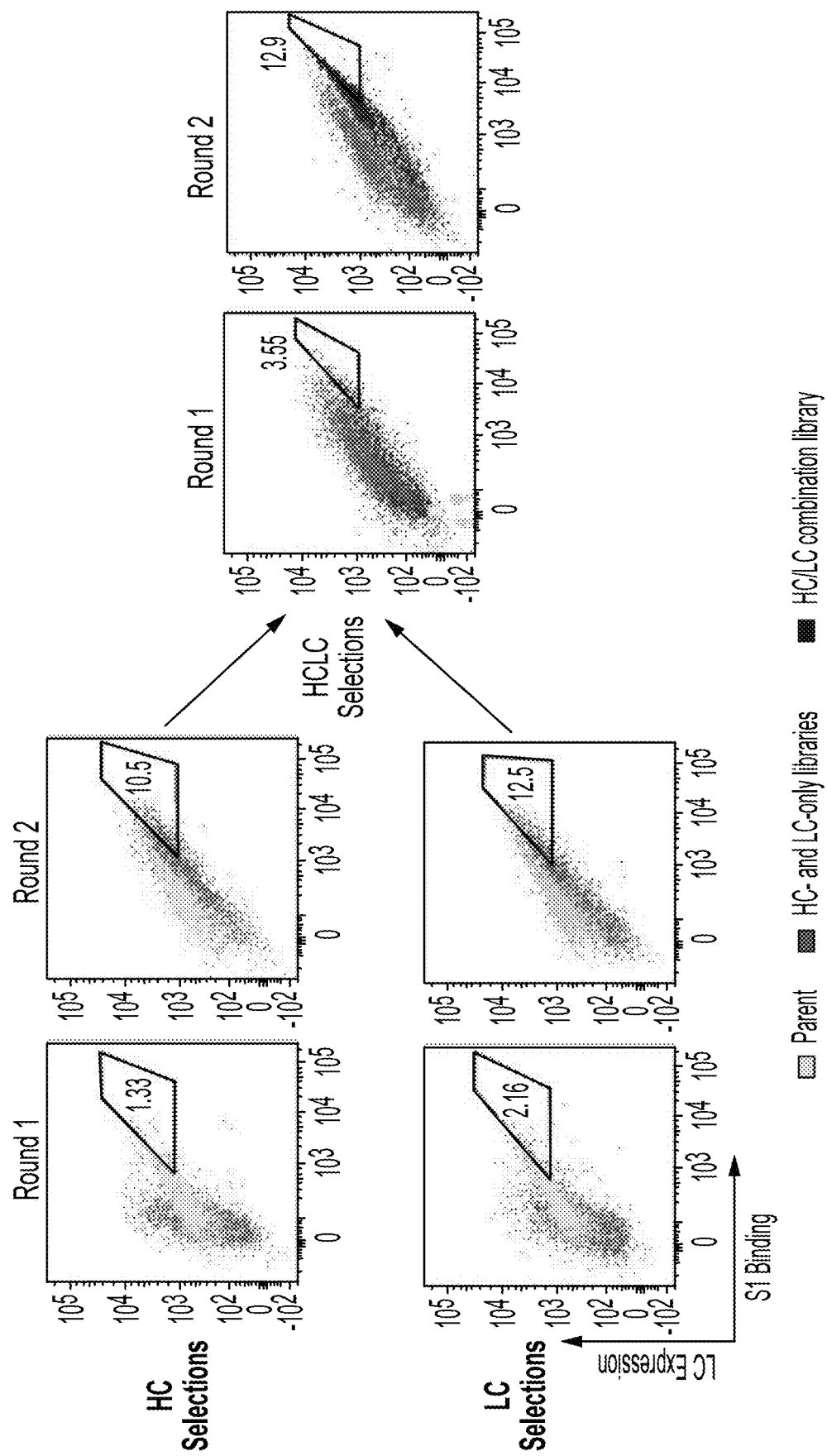
FIG. 30C provides representative yeast surface display library selections. Four flow cytometry panels on the left show flow cytometric sorting of yeast display libraries containing diversity in the ADI-55688 HC (top) or LC (bottom). Libraries were sorted for improved binding to the SARS-CoV-2 S1 protein relative to the parent clone. Round 1 gates indicate the yeast populations that were sorted for a second round of selection, and round 2 gates indicate the yeast populations that were sorted for amplification of heavy- or light-chain variable region genes and transformation into yeast for HC/LC combinatorial library generation. Two flow cytometry panels on the right shown flow cytometric sorting of HC/LC combinatorial libraries. Libraries were sorted for improved binding to the SARS-CoV-2 S1 protein relative to the round 2 output of the HC diversity libraries. The round 1 gate indicates the yeast population that was sorted for a second round of selection and the round 2 gate indicates the yeast population that was sorted for individual colony picking. The scheme illustrates the combined heavy chain and light chain selection for affinity maturation in Example 12, FIG. 30D provides flow cytometry plots from the terminal round of selection showing binding of parental antibodies and affinity maturation libraries to the SARS-CoV-2 S1 protein at a 1 nM concentration. Gates indicate the yeast populations sorted for antibody sequencing and characterization.

Combined heavy chain and light chain selection (scheme shown in FIG. 30C): The variable regions (FR1-FR4) from the highest affinity IgGs of VH CDR1, VH CDR2, and VH CDR3 maturation cycle were combined with the highest affinity IgGs of the VL CDR1, VL CDR2, and $V_L$ CDR3 maturation cycle and transformed into yeast. Selections were performed with two rounds of FACS, enriching for the highest affinity biotinylated SARS-CoV-2 S1 protein binders. To select for antibodies with better affinity than the input heavy chain or light chain IgGs via FACs, the final sort population was compared to the final rounds of the VH CDR1, VH CDR2, and VH CDR3/$V_L$ CDR1, VL CDR2, and VL CDR3 maturation output. Affinity matured progenies were assayed for the affinity for SARS-CoV-2 S protein and for the SARS-CoV and SARS-CoV-2 neutralization ability as described in Examples 13 and 14, and based on the results, ADI-57983, ADI-57978, and ADI-56868, affinity-matured progenies of ADI-55689, ADI-55688, and ADI-56046, respectively, were selected as the best progenies.

Figure 30D:
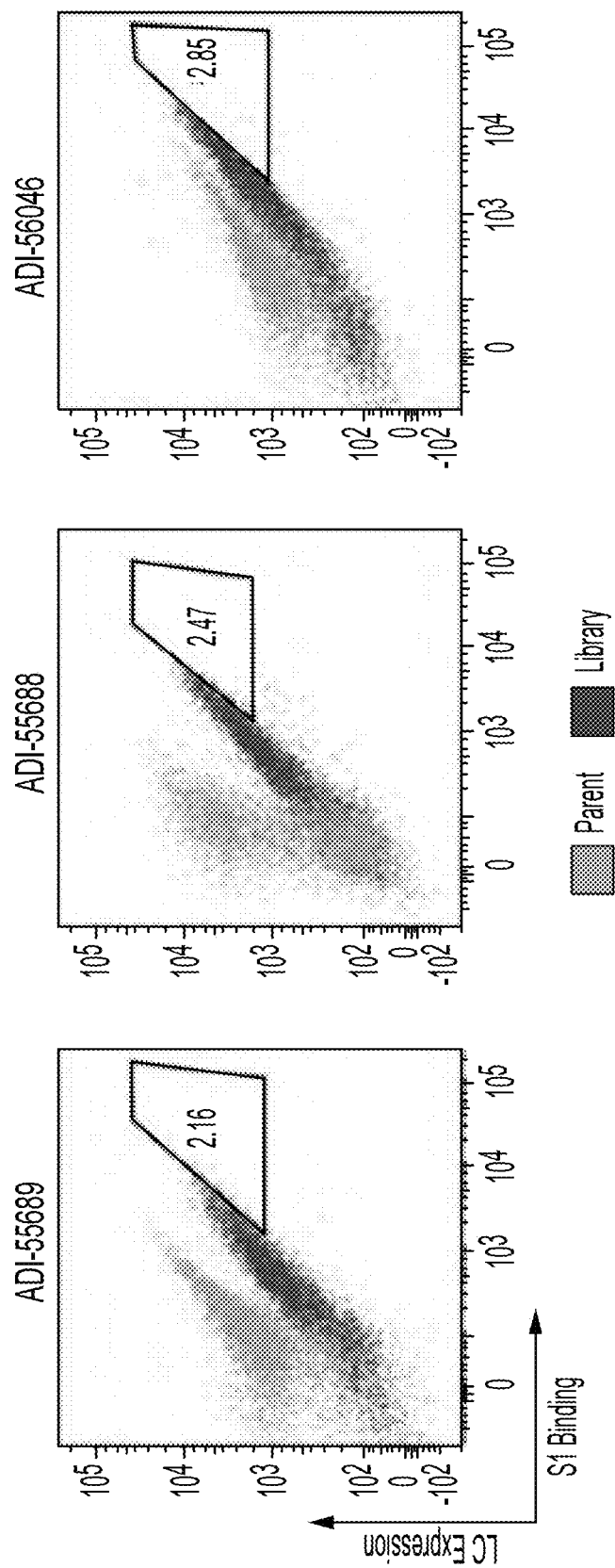
FIG. 30B provides a graph comparing parent antibodies (i.e., before affinity maturation in Example 12) and affinity maturation progenies for the ability to neutralize authentic SARS-CoV-S and SARS-CoV-2, measured in Example 14. Data points corresponding to the lead progeny derived from ADI-55689 are marked "ADI-57983".

FIG. 30D further shows that binding to the S1 subunit of SARS-CoV-2-S is much higher in the affinity maturation progeny library relative to the respective parent antibodies, ADI-55689, ADI-55688, or ADI-56046.

The sequences of the VH and VL and CDRs and FRs of the VH and VL of selected antibodies are provided in FIGS. 36A and 36B. Sequence alterations relative to the germline or germline-encoded sequences are caused by somatic mutation and alterations caused by degenerate primers, are also referred to as "primer mutation" herein.

Figures 29, 30A:
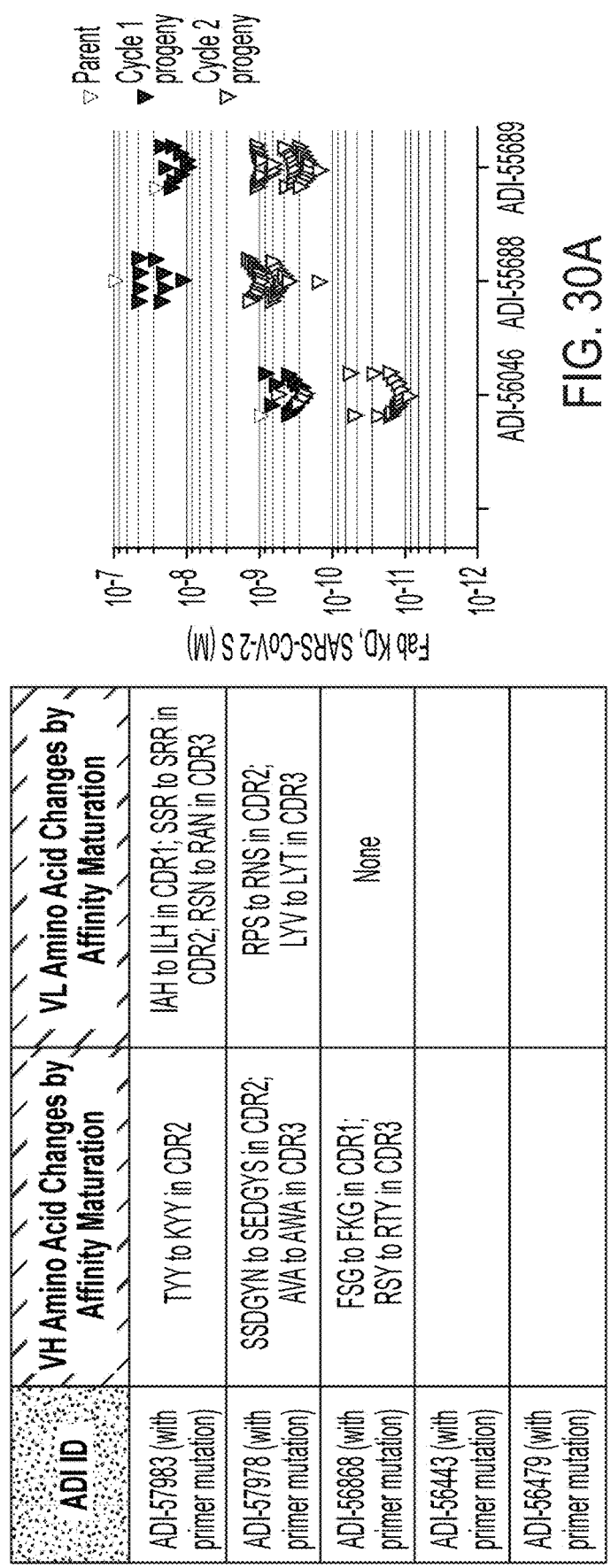
FIG. 29 provides the amino acid changes introduced by affinity maturation in Example 12. Amino acid changes for ADI-57983, ADI-57978, and ADI-56868 are relative to the sequence the parent (i.e., before affinity maturation in Example 12) antibody, ADI-55689, ADI-55688, and ADI-56046, respectively.
FIG. 30A provides a graph comparing affinity to SARS-CoV-2-S of parent antibodies (i.e., before affinity maturation in Example 12) and affinity maturation progenies (after one or two cycles), measured in Example 13.

Example 13: Kinetics of Binding Measurements (SARS-CoV-2-S) with the Parent Antibodies and Affinity-Matured Progenies The parent antibodies (i.e., before affinity maturation), ADI-55689, ADI-55688, and ADI-56046, and Cycle 1 and Cycle 2 progenies generated via affinity maturation, including ADI-57983, ADI-57978, and ADI-56868, obtained in in Example 12, were expressed as a Fab using the method described in Example 1, and the apparent binding affinities ($K_D^{APPs}$) of each Fab to prefusion-stabilized SARS-CoV-2 S protein were determined by BLI (4 hour incubation) as described in Example 2. The results are provided in FIG. 30A, which shows marked improvement (approximately 25- to 630-fold improvements) in the affinity to SARS-CoV-2-S of Cycle 1 progenies over the respective parents and in Cycle 2 progenies over the respective Cycle 1 progenies.

Example 14: Micro-Titer Neutralization Assays with the Parent Antibodies and Affinity-Matured Progenies 14-1: Authentic SARS-CoV and SARS-CoV-2 Neutralization Assay Neutralization of authentic SARS-CoV and SARS-CoV-2 by the parent antibodies (i.e., before affinity maturation), ADI-55689, ADI-55688, and ADI-56046, and affinity matured progenies, including ADI-57983, ADI-57978, and ADI-56868, obtained in Example 13, was measured using the method described in 6-1 of Example 6. The results are provided in FIG. 30B, which shows marked improvement in the ability to neutralize both SARS-CoV and SARS-CoV-2 by affinity maturation.

Based on the results in Examples 13 and 14, it was found that improvements in SARS-CoV-2 S protein affinity translate to improvements in neutralization. The IC50 values of ADI-57983, ADI-57978, and ADI-56868 are also provided in FIG. 31A.

14-2: SARS-CoV-MLV and SARS-CoV-2 MLV Pseudo Viral Particle Neutralization Assay Neutralization of SARS-CoV and SARS-CoV-2 MLV pseudo viral particle by ADI-57983, ADI-57978, and ADI-56868, obtained in Example 13, was measured using the method described in 6 3 of Example 6.

The results are provided in FIG. 30B, which shows highly similar results to those from the authentic virus neutralization studies in 14-1. The IC50 values of ADI-57983, ADI-57978, and ADI-56868 are also provided in FIG. 31A.

Example 15: Selection and Preparation of Antibodies that Selectively Bind SARS-CoV-2-S Using Blood Samples from Convalescent COVID-19 Patients ADI-56443 and ADI-56479 were identified as potent neutralizing antibodies with high affinity for the RBD and NTD, respectively, of the spike (S) protein of SARS-CoV-2.
Sample Heparinized blood (50-100 cc) was obtained from two subjects (2019-2020 SARS-CoV-2 outbreak survivor) one month after infection (Donor names: "EMC10" and "EMC15"). The sample was processed to obtain plasma and to isolate peripheral blood-derived B cells. Isolated cells and plasma were stored frozen in aliquots at −80° C.
Antigens and Antibodies Production of recombinant SARS-CoV-2 spike protein: To express the prefusion S ectodomain of SARS-CoV-2, a gene encoding residues 1-1208 of 2019-nCoV S (GenBank: MN908947) with proline substitutions at residues 986 and 987, a "GSAS" substitution ("GSAS" disclosed as SEQ ID NO: 23196) at the furin cleavage site (residues 682-685), a C-terminal T4 fibritin trimerization motif, an HRV3C protease cleavage site, a TwinStrepTag and an 8XHisTag (SEQ ID NO: 23197) was synthesized and cloned into the mammalian expression vector pαH (DOI: 10.1126/science.abb2507). Expression construct design was based on previously described strategies for expression of related betacoronavirus S proteins (DOI: 10.1073/pnas.1707304114 and DOI: 10.1038/s41598-018-34171-7) These expression vector encoding SARS-CoV-2 S protein was used to transiently transfect FreeStyle293F cells (Thermo 134 Fischer) using polyethylenimine Protein was purified from filtered cell supernatants using either 135 StrepTactin resin (IBA) or Protein A resin (Pierce) before being subjected to additional 136 purification by size-exclusion chromatography using either a Superose 6 10/300 column (GE 137 Healthcare) or a Superdex 200 10/300 Increase column (GE Healthcare) in 2 mM Tris pH 8.0, 138 200 mM NaCl and 0.02% NaN3. The final protein preparations were stored in phosphate-buffered saline pH 7.4 supplemented with an additional 150 mM NaCl. Small aliquots were stored at −70° C. until use.
Single B-Cell Sorting For MBC sorting, B cells were purified using a MACS B cell isolation kit (Miltenyi Biotec; cat #130-091-151) and subsequently stained using anti-human CD19 (PE-Cy7), CD3 (PerCP-Cy5.5), CD8 (PerCP-Cy5.5), CD14 (PerCP-Cy5.5), CD16 (PerCP-Cy5.5), IgM (BV711), IgD (BV421), IgA (AF488), IgG (BV605), CD27 (BV510), CD71 (APC-Cy7) and dual-labeled (APC and PE) SARS-CoV-2 spike protein tetramer (25 nM). Tetramer was prepared fresh for each experiment, and B cells that showed reactivity to the SARS-CoV-2 spike protein tetramer was single cell sorted. Single cells were sorted using a BD FACS Aria II (BD Biosciences) into 96-well PCR plates (BioRAD) containing 20 uL/well of lysis buffer [5 uL of 5× first strand cDNA buffer (Invitrogen), 0.625 uL of NP-40 (New England Biolabs), 0.25 uL RNaseOUT (Invitrogen), 1.25 uL dithiothreitol (Invitrogen), and 12.6 uL dH2O]. Plates were immediately stored at −80° C. Flow cytometry data were analyzed using FlowJo software.
Amplification and Cloning of Antibody Variable Genes Antibody variable genes (IgH, IgK, and IgL) were amplified by reverse transcription PCR and nested PCRs using cocktails of IgG- and IgM-specific primers, as described previously (Tiller et al, J Immunol 2008). The primers used in the second round of PCR contained 40 base pairs of 5' and 3' homology to the digested expression vectors, which allowed for cloning by homologous recombination into *S. cerevisiae*. The lithium acetate method for chemical transformation was used to clone the PCR products into *S. cerevisiae* (Gietz and Schiestl, Nat Protoc 2007). 10 uL of unpurified heavy chain and light chain PCR product and 200 ng of the digested expression vectors were used per transformation reaction. Following transformation, individual yeast colonies were picked for sequencing and characterization. Cognate antibody heavy- and light-chain pairs were rescued from individual B cells and cloned. The sequences, the germline origins, and isotypes were determined. The number of nucleic acid substitutions relative to the germline sequences and the number of amino acid alterations relative to the germline-encoded sequences were also analyzed. The sequences of the VH and VL and CDRs and FRs of the VH and VL of two identified antibodies, ADI-56443 and ADI-56479, are provided in FIGS. 36A and 36B. Sequence alterations relative to the germline encoded sequences are shown in red (caused by somatic mutation) and orange (caused by degenerate primers, also referred to as "primer mutation" herein). Germline origins and isotypes are provided in FIGS. 31 and 35.
Expression and Purification of IgGs and Fab Fragments IgGs were expressed in *S. cerevisiae* cultures grown in 24-well plates, as described previously (Bornholdt et al, Science 2016, PMID:26912366). After 6 days, the cultures were harvested by centrifugation and IgGs were purified by protein A-affinity chromatography. The bound antibodies were eluted with 200 mM acetic acid/50 mM NaCl (pH 3.5) into ⅛th volume 2 M Hepes (pH 8.0), and buffer-exchanged into PBS (pH 7.0).

CR3022 was cloned into *S. cerevisiae* using recombinational cloning. The variable region sequences of CR3022 were synthesized as gBlock fragments (IDT) with homologous overhangs which were cloned and expressed as described above.

Fab fragments were generated by digesting the IgGs with papain for 2h at 30° C. The digestion was terminated by the addition of iodoacetamide, and the Fab and Fc mixtures were passed over Protein A agarose to remove Fc fragments and undigested IgG. The flowthrough of the Protein A resin was then passed over CaptureSelect™ IgG-CH1 affinity resin (ThermoFischer Scientific) and eluted with 200 mM acetic acid/50 mM NaCl pH 3.5 into ⅛th volume 2M Hepes pH 8.0. Fab fragments then were buffer-exchanged into PBS pH 7.0.

Example 16: Kinetics of Binding Measurements (S Protein of SARS-CoV-2 and Seasonal Coin) with the Antibodies Isolated from Covalescent COVID-19 Patients Bio-Layer Interferometry Kinetic Measurements (BLI):

The apparent binding affinities ($K_D^{APPs}$) of ADI-56443 and ADI-56479, obtained in in Example 15, to prefusion-stabilized S protein of SARS-CoV-2 or HKU1 were determined by BLI (4 hour incubation) as described in Example 2. The results are provided in FIGS. 32B and 32G, which shows that both ADI-56443 and ADI-56479 bind to SARS-CoV-2-S but neither ADI-56443 nor ADI-56479 binds to HKU1-S.

FRNT Assay:

ADI-56443 and ADI-56479, obtained in in Example 15, were expressed as human IgG as described in Example 15, and the apparent binding affinities ($K_D^{APPs}$) for SARS-CoV-S and SARS-CoV-2-S protein were determined.

For SARS CoV or SARS-CoV-2 spike protein binding ELISAs, 96-well plates (Corning; Cat #3690) were coated with 5 µg/ml of SARS CoV or SARS-CoV-2 spike protein diluted in PBS and incubated overnight at 4° C. Wells were washed and then blocked with 5% non-fat dried milk (NFDM) in PBS for 1 hour at 37° C. Wells were washed 3 times with PBS and serial dilutions of human plasma in 5% NFDM-PBS were added and incubated for 1 hour at 37° C. Plates were then washed 3 times with PBS and secondary cross-adsorbed anti-human IgG-HRP (Thermo Fisher Scientific; cat #31413) or anti-human-IgM (Sigma Aldrich; cat #AP114P) detection antibodies were added at 1:8000 dilution in 5% NFDM-PBS for 1 hour at 37° C. After washing 3 times with PBS detection reagent was added per manufacturer recommendations (Thermo Scientific; Cat #34029) and absorbance was measures at 450 nM wavelength using a Spectramax microplate Reader (Molecular Devices).

The results showed that both ADI-56443 and ADI-56479 bind to SARS-CoV-2-S (data not shown).

Example 17: Micro-Titer Neutralization Assays with ADI-56443 and ADI-56479

17-1: Authentic SARS-CoV-2 Neutralization Assay

Neutralization of authentic SARS-CoV-2 by ADI-56443 and ADI-56479, obtained in Example 15, was measured using the method described in 6-1 of Example 6. The results are provided in FIGS. 31A and 33. Both ADI-56443 and ADI-56479 efficiently neutralized authentic SARS-CoV-2.

17-2: rVSV-SARS-CoV-2 Neutralization Assay

Neutralization of SARS-CoV-2 rVSV pseudo viral particle by ADI-56443 and ADI-56479, obtained in Example 15, was measured using the method described in 6-2 of Example 6.

The results are provided in FIGS. 31A and 33. Both ADI-56443 and ADI-56479 efficiently neutralized SARS-CoV-2 rVSV pseudoviruses.

Example 18: Developability Profile Analysis

For each of ADI-57983, ADI-57978, and ADI-56868, obtained in Example 12, and ADI-56443 and ADI-56479, obtained in Example 15, the acceptability for multiple biophysical metrics of "developability" were assessed using a panel of assays: PSR, HIC, and Tm.

Polyspecificity (also referred to as polyreactivity) is a highly undesirable property that has been linked to poor antibody pharmacokinetics (Wu et al., J Mol Biol 368:652-665, 2007; Hötzel et al., 2012, MAbs 4(6):753-760) and, thus, potentially to poor developability. Antibodies can be detected as possessing decreased or increased developability by virtue of their level of interaction with poly specificity reagent (PSR). See WO2014/179363. Antibodies displaying increased interaction with PSR are referred to as "polyspecific" polypeptides, with poor(er) developability. SARS2 antibodies selected or identified as possessing enhanced developability based on low polyspecificity score are considered "developable".

A poly specificity of each antibody was measured as described previously (L. Shehata et al., Affinity Maturation Enhances Antibody Specificity but Compromises Conformational Stability. *Cell reports* 28, 3300-3308 e3304 (2019)). Briefly, soluble membrane protein (SMP) and soluble cytosolic protein (SCP) fractions obtained from Chinese hamster ovary (CHO) cells were biotinylated using NHS-LC-Biotin (Thermo Fisher Scientific Cat #21336). IgGs presented on the surface of yeast were incubated with 1:10 diluted biotinylated CHO cell preparations on ice for 20 minutes. Cells were then washed twice with ice-cold PBS containing 0.1% BSA (PBSF) and incubated in 50 μL of a secondary labelling mix containing ExtrAvidin-R-PE (Sigma-Aldrich), anti-human LC-FITC (Southern Biotech) and propidium iodide) for 15 minutes. The cells were washed twice with PBSF and resuspended in PBSF to be run on a FACSCanto II (BD Biosciences). The mean fluorescence intensity of binding was normalized using control antibodies that display low, medium or high poly specificity to assess the non-specific binding. The results are summarized in FIG. 31B.

The poly specificity score can be useful, as one or one of many metrics, in ranking the antibodies based on developability. For example, the antibodies can be ranked as clean (below 0.11), low (below 0.33), medium (below 0.66), and high polyspecificity (above 0.66). The antibodies were categorized as A when the Score is below 0.10. and as B when the Score is 0.10 or higher. All tested antibodies were "A".

Hydrophobic interaction chromatography (HIC) was performed to assess hydrophobic interaction of the lead antibodies. The methodology for this assay was described previously (see Estep P, et al. (2015) An alternative assay to hydrophobic interaction chromatography for high-throughput characterization of monoclonal antibodies. MAbs 7(3): 553-561). In brief, 5 μg IgG samples (1 mg/mL) were spiked in with a mobile phase A solution (1.8 M ammonium sulfate and 0.1 M sodium phosphate at pH 6.5) to achieve a final ammonium sulfate concentration of about 1 M before analysis. A Sepax Proteomix HIC butyl-NP5 column was used with a liner gradient of mobile phase A and mobile phase B solution (0.1 M sodium phosphate, pH 6.5) over 20 min at a flow rate of 1 mL/min with UV absorbance monitoring at 280 nm. Results are summarized in FIG. 31B.

Lastly, Tm was measured using DSF. The Tm was determined using a CFX96 Real-Time System from Bio-Rad, based on the protocol described earlier (32). Briefly, 20 μL of 1 mg/mL sample was mixed with 10 μL of 20× SYPRO orange. The plate was scanned from 40° C. to 95° C. at a rate of 0.5° C./2 min. The Fab Tm was assigned using the first derivative of the raw data from the Bio-Rad analysis software. Results are summarized in FIG. 31B. FIG. 31B further provides pI (isoelectric point) values.

Collectively, ADI-57983, ADI-57978, ADI-56868, ADI-56443, and ADI-56479 have favorable developability profiles.

Example 19: Epitope Mapping

Epitope mapping was performed for ADI-57983, ADI-57978, and ADI-56868, obtained in Example 12, and ADI-56443 and ADI-56479, obtained in Example 15, using different subunit and domain constructs of SARS-CoV-2-S using ForteBio-based competition assays.

The domain/subunit used for the binding studies were the 51 subunit, S2 subunit, the RBD, and NTD and for the binding to RBD and NTD, monovalent binding and bivalent ("AVID") binding were both measured.

For the competition studies, the competition of each antibody with recombinant human ACE2 ("hACE2") and with a commercial antibody CR3022, which targets a conserved epitope outside of the receptor binding site, was tested (M. Yuan et al., A highly conserved cryptic epitope in the receptor-binding domains of SARS-CoV-2 and SARS-CoV. Science, (2020)).

Figure 32B:
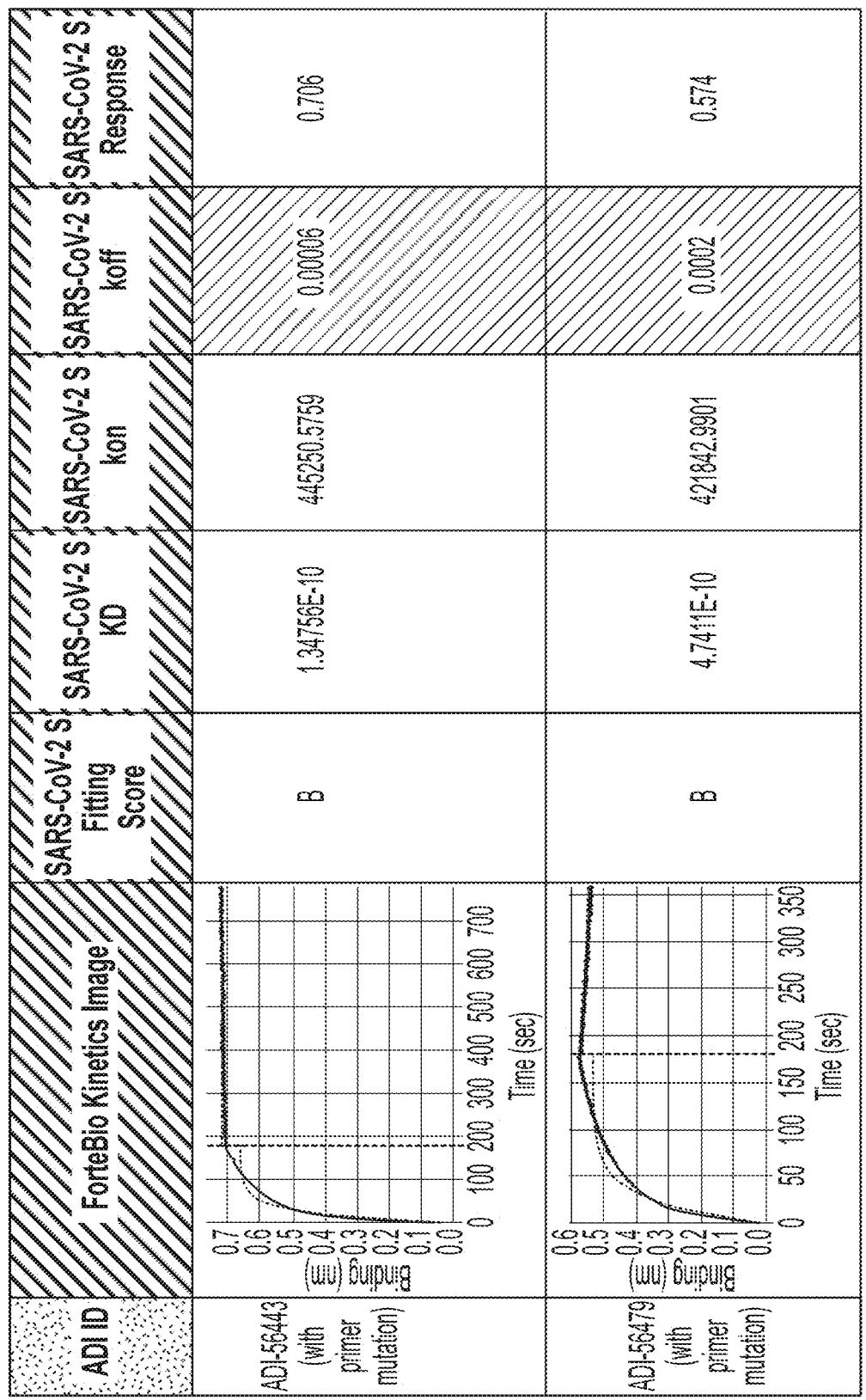
Figure 32C:
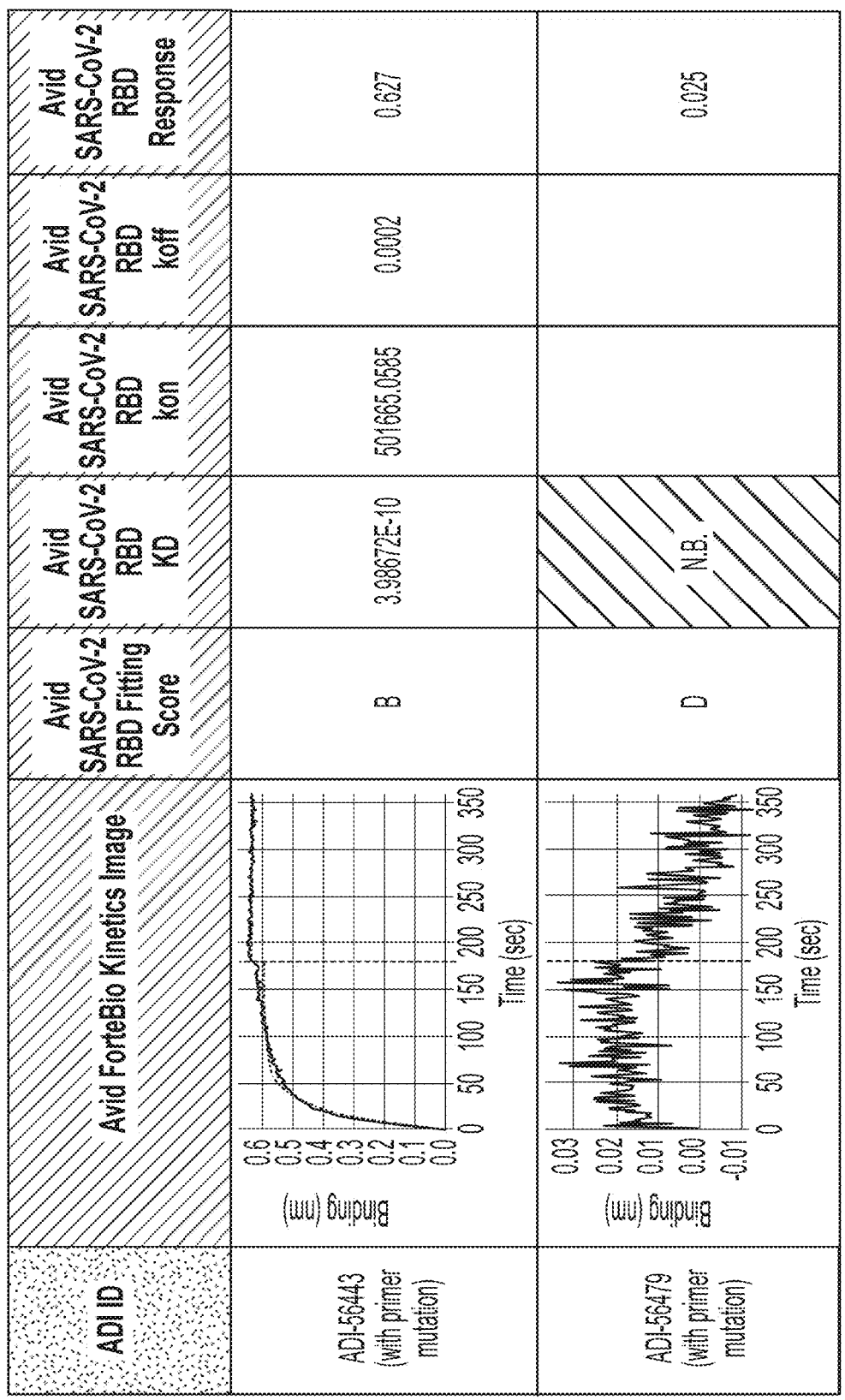
Figure 32D:
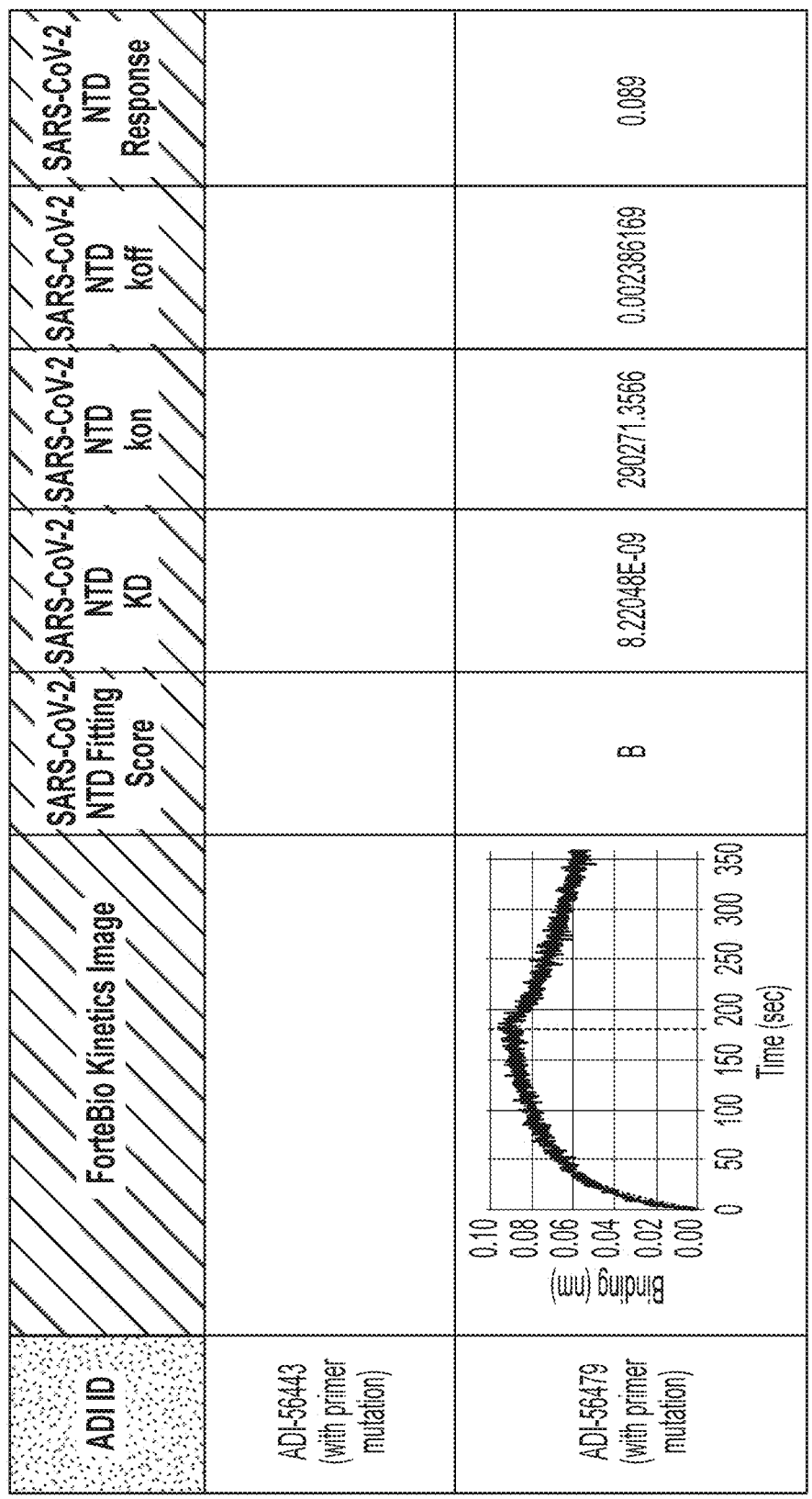
Figure 32E:
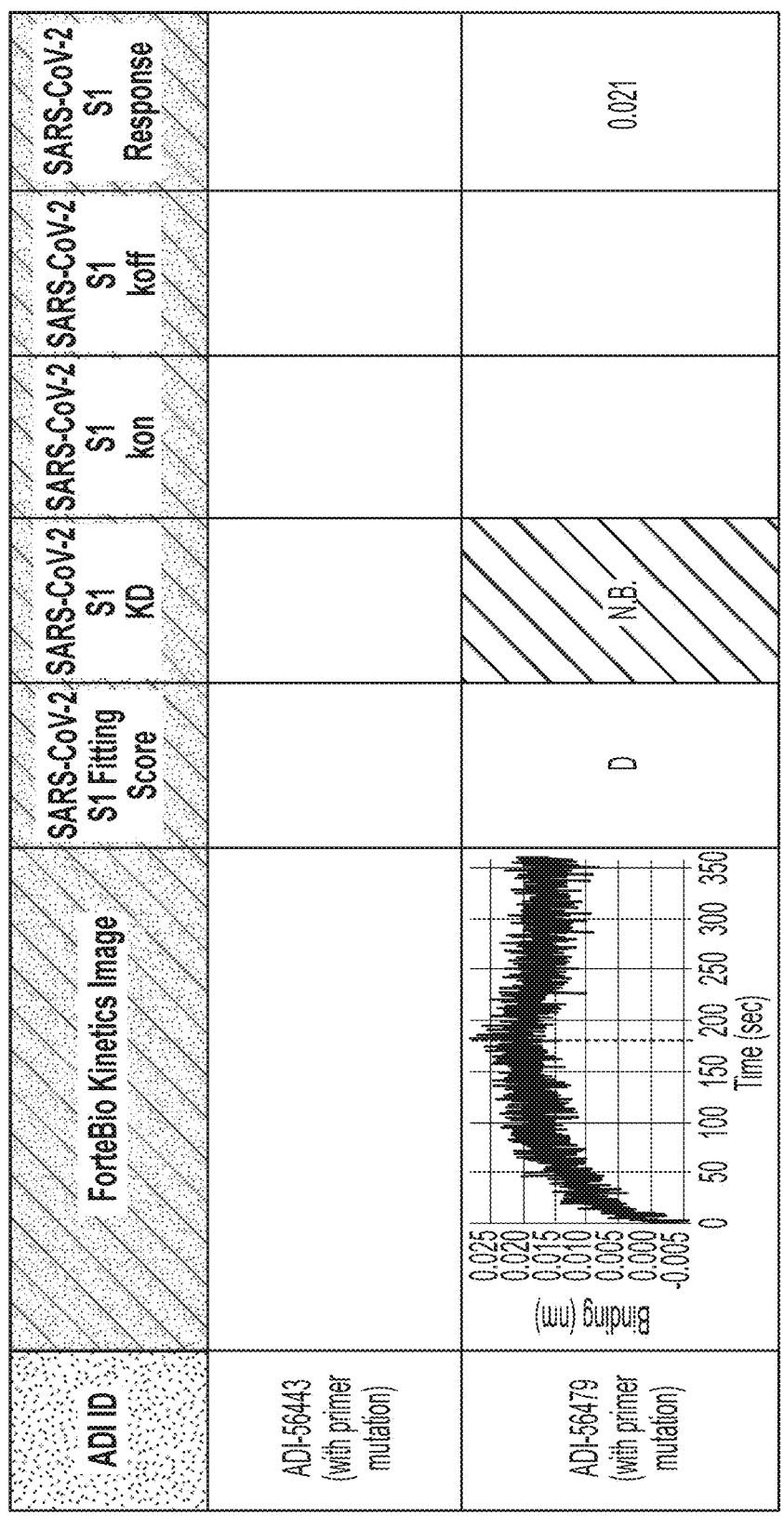
Figure 32F:
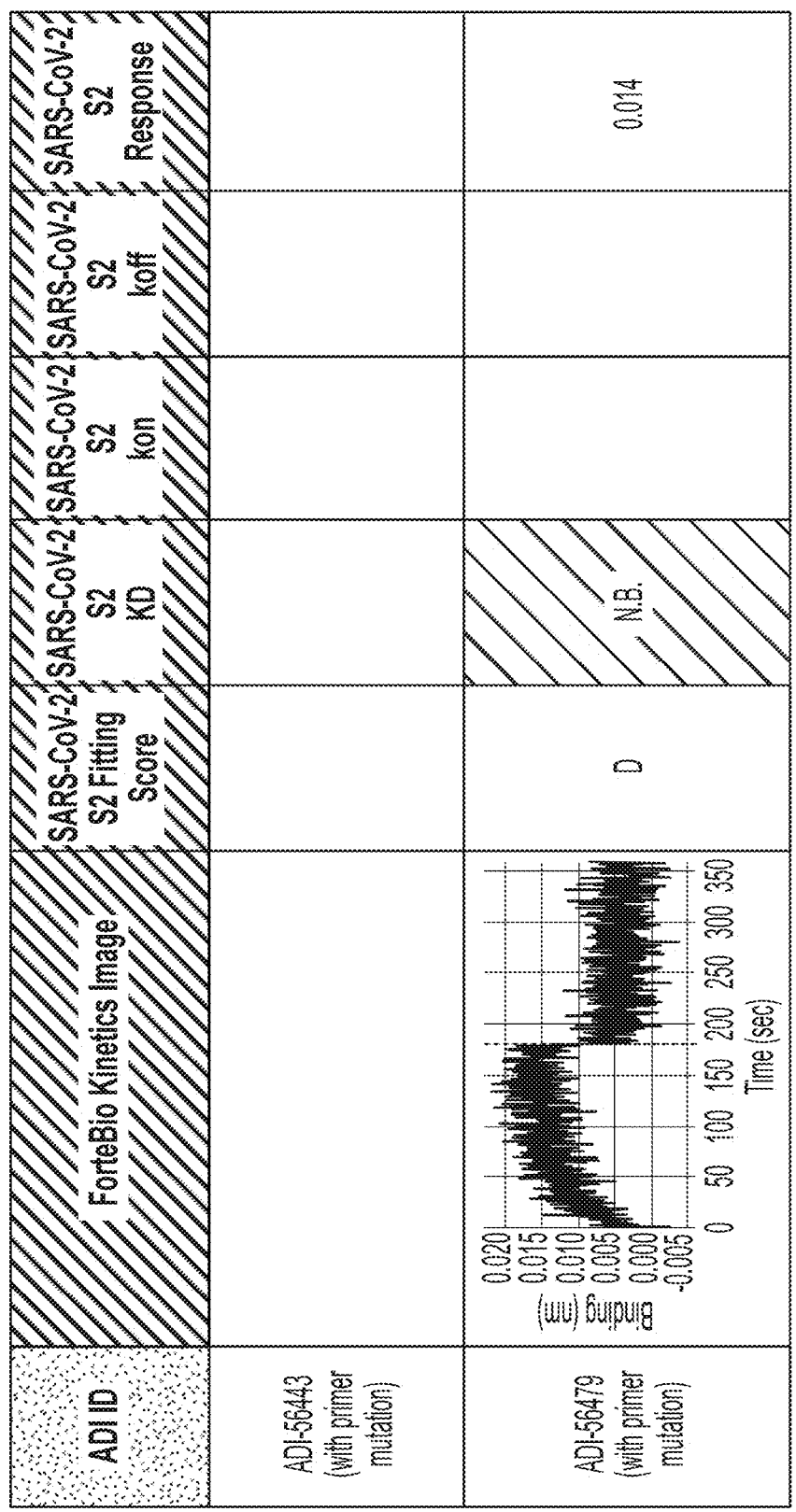
Figure 32G:
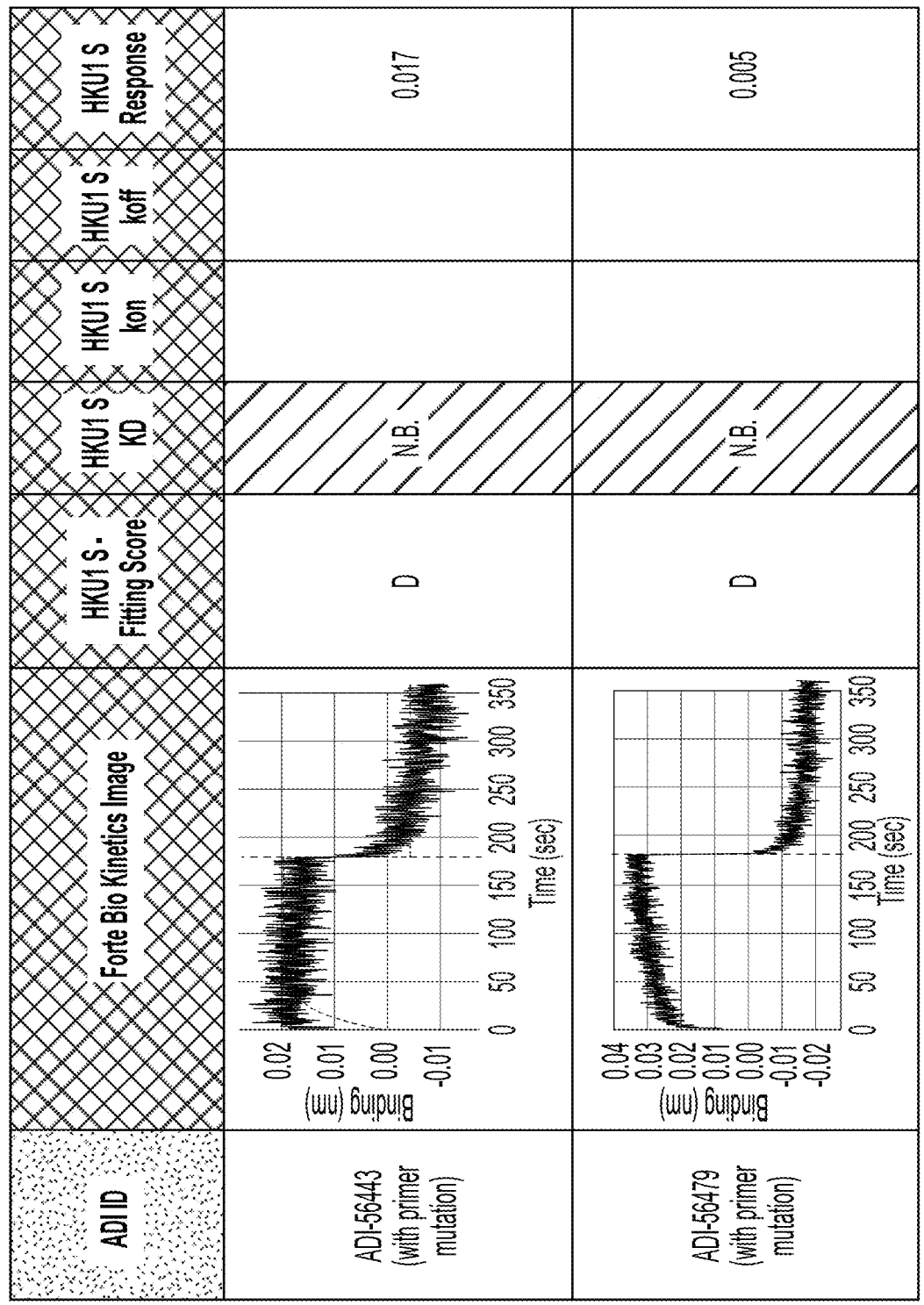
Figure 32H:
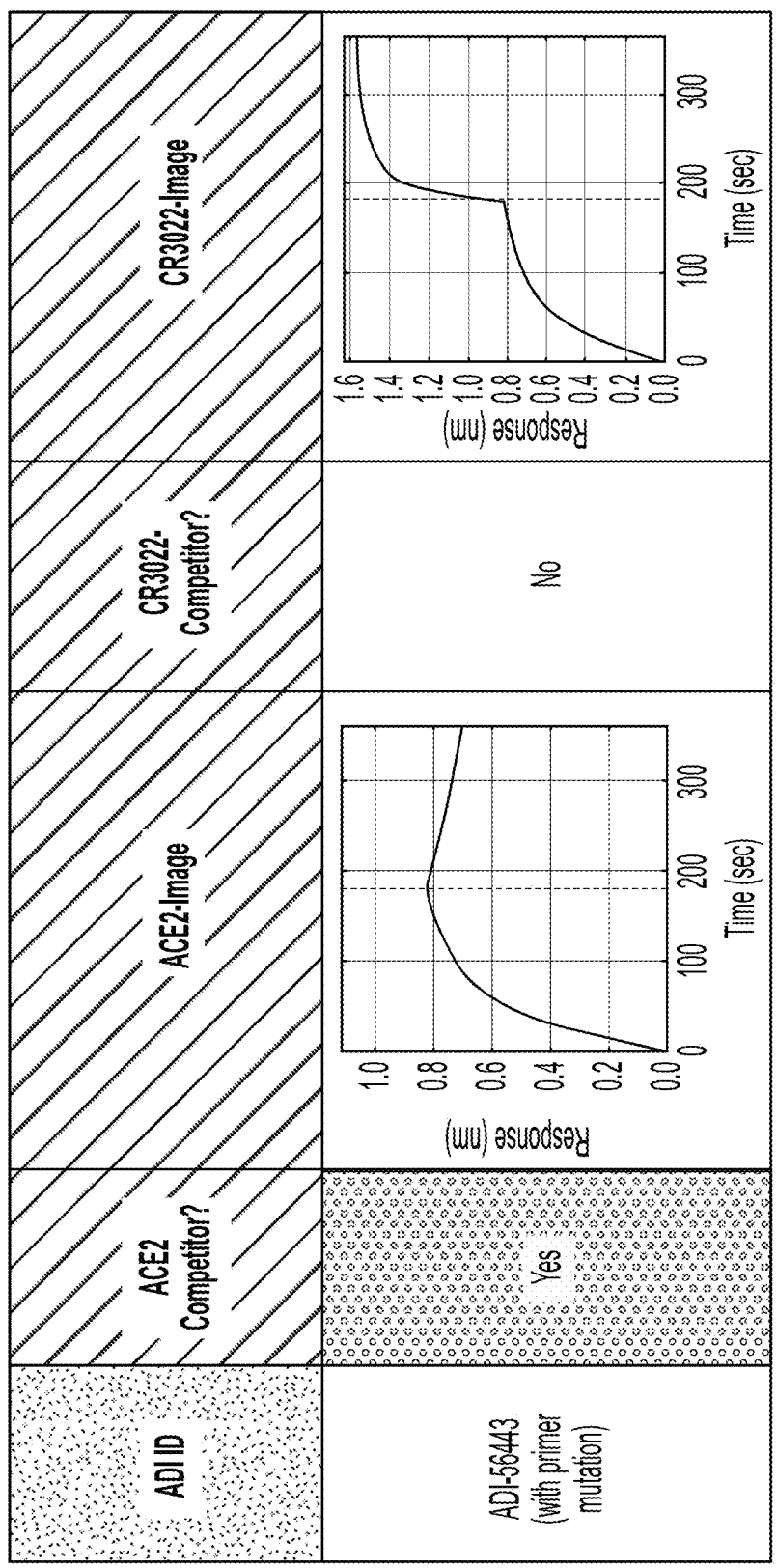
Figure 32I:
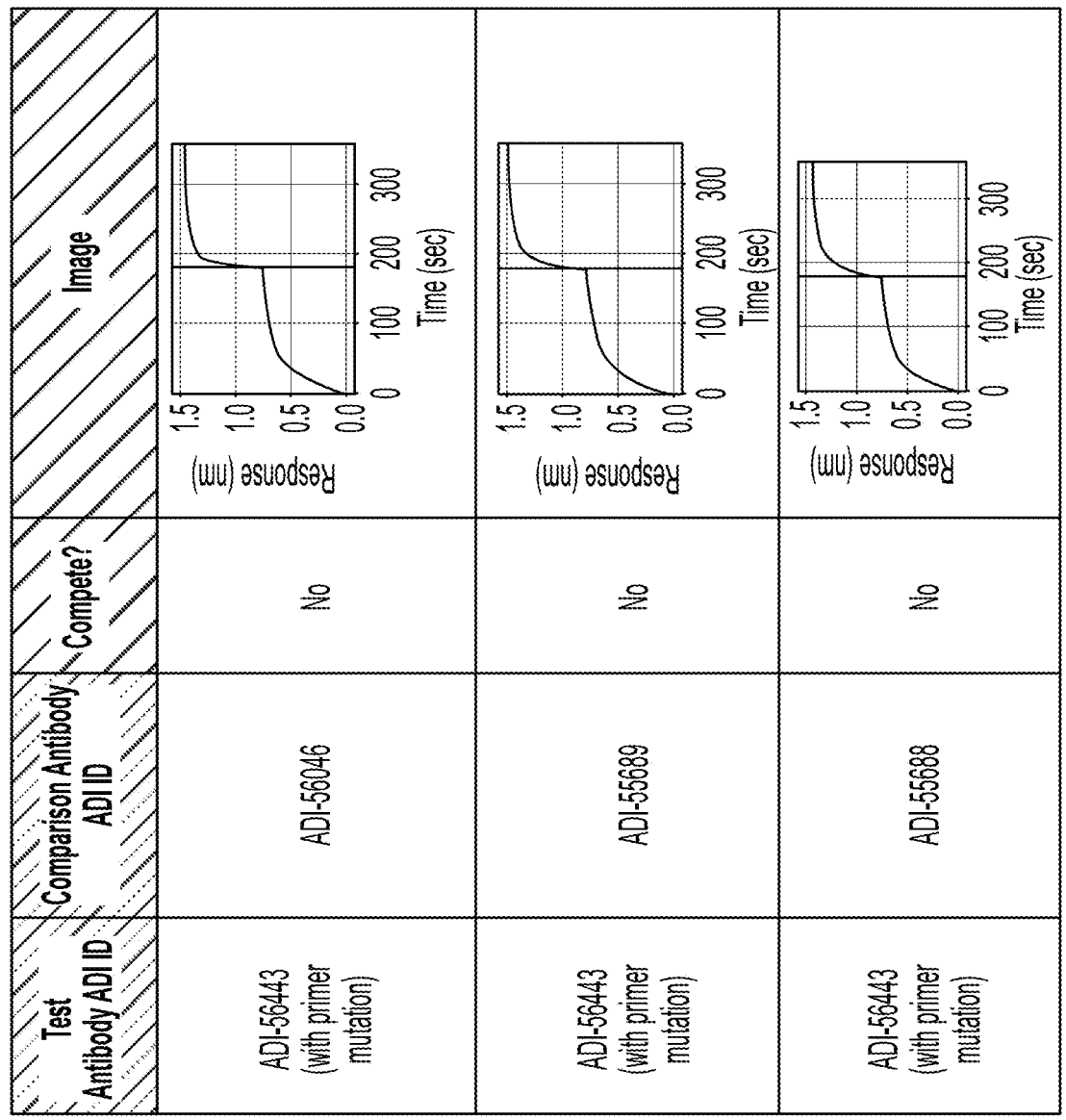
FIGS. 32I-32J provide the results from the cross-competition study in Example 20 for selected antibodies.

Results are summarized in FIGS. 31A and 32A. ADI-57983, ADI-57978, ADI-56868, and ADI-56443 recognized epitopes within the RBD and compete with hACE2, whereas ADI-56479 recognized an epitope in the NTD. Binding data for ADI-56443 and ADI-56479 are also provided in FIGS. 32B-32G, and the competition results for ADI-56443 is provided in FIG. 32I1.

Example 20: Cross Competition

Cross-competition of antibodies for binding to recombinant SARS-CoV-2 RBD was evaluated using a ForteBio Octet HTX instrument (Molecular Devices). All binding steps were performed at 25° C. and at an orbital shaking speed of 1000 rpm. All reagents were formulated in PBSF buffer (PBS with 0.1% w/v BSA). The IgGs (100 nM) were captured to anti-human IgG capture (AHC) biosensors (Molecular Devices) to a sensor response of 1.0 nm-1.4 nm, the remaining unoccupied binding sites on the biosensor were blocked with an inert IgG (0.5 mg/mL), and then allowed to equilibrate in PBSF for a minimum of 30 min. To assess any cross interactions between proteins on the sensor surface and the secondary molecules, the loaded and blocked sensors were exposed (90 s) to competitor IgG (300 nM) prior to the binning analysis. After a short baseline step (60 s) in PBSF, the IgG-loaded biosensor tips were exposed (180 s) to the SARS-CoV-2 RBD-SD1 antigen (100 nM) and then exposed (180 s) to competitor IgG (300 nM). The data was y-axis normalized, and interstep corrected using the FortéBio Data Analysis Software version 11.0. Additional binding by the secondary molecule indicates an unoccupied epitope (non-competitor), while no binding indicates epitope blocking (competitor). Antibodies with a binding response value of <0.1 were considered to be non-binders.

Figure 32J:
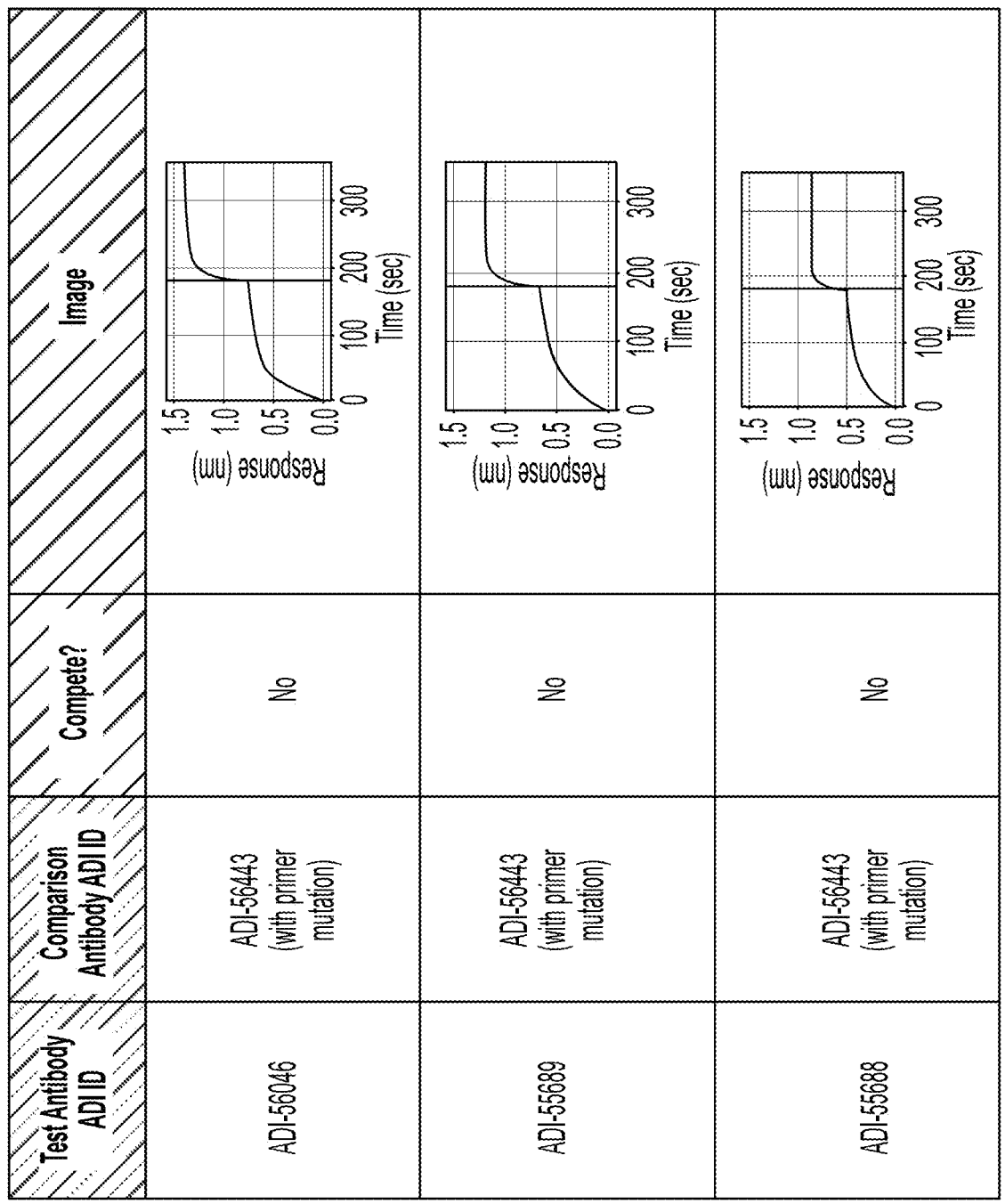

Notably, ADI-56443 does not compete with ADI-55689, ADI-55688, and ADI-56046 (FIGS. 32I and 32J) and, likewise, are not expected to compete with ADI-57983, ADI-57978, ADI-56868.

Example 21: Primer Mutation Fix

As described above in Examples 12 and 15, ADI-57983, ADI-57978, and ADI-56868, obtained in Example 12, and ADI-56443 and ADI-56479, obtained in Example 15, contained at least one "primer mutation" caused by the use of degenerate primers. The "primer mutation(s)" in the variable region sequences of ADI-57983, ADI-57978, ADI-56868, ADI-56443, and ADI-56479 were fixed back to the germline-encoded amino acid(s), and the resulting antibodies were named ADI-58120, ADI-58124, ADI-58126, ADI-58128, and ADI-58130, respectively Amino acid changes are also explained in FIG. 34. The VH and VL sequences of ADI-58120, ADI-58124, ADI-58126, ADI-58128, and ADI-58130 are provided in FIGS. 36A and 36B, and the number of differences in the amino acids and nucleotides relative to the germline-coded or germline sequences is summarized in FIG. 35.

Additionally, a variant of ADI-58130, which differs from ADI-58130 by only one amino acid in the variable region sequence, was obtained and named ADI-58130-LCN30cQ. The variant has "Q" instead of "N" in the light chain CDR1. The variable region sequences of ADI-58130-LCN30cQ are also provided in FIGS. 36A and 36B).

The variable region sequences of any of these six antibodies (ADI-58120, ADI-58124, ADI-58126, ADI-58128, and ADI-58130, and ADI-58130-LCN30cQ) or any other antibodies described herein may be used with a wild type or variant Fc region. Examples of Fc variants including wild-type Fc are provided in Table 1. Heavy and light chain sequences of exemplary antibodies using the variable region sequences of ADI-58120, ADI-58124, ADI-58126, ADI-58128, or ADI-58130 and one of the Fc sequences provided in Table 1 are provided in Table 2, and separate ADI IDs are assigned for respective antibodies (see FIGS. 36A and 36B for SEQ ID NOs).

TABLE 2

Exemplary Antibodies With Different Variable Region Sequences And Fc Sequences.

| ADI ID | Variable Region Same As | Fc Variant Name |
|---|---|---|
| ADI-58120 | ADI-58120 | WT |
| ADI-58121 | ADI-58120 | YTE |
| ADI-58122 | ADI-58120 | LA |
| ADI-58123 | ADI-58120 | LS |
| Not assigned | ADI-58120 | LA-RE |
| ADI-58124 | ADI-58124 | WT |
| ADI-58125 | ADI-58124 | LA |
| ADI-58126 | ADI-58126 | WT |
| ADI-58127 | ADI-58126 | LA |
| ADI-58128 | ADI-58128 | WT |
| ADI-58130 | ADI-58130 | WT |
| ADI-58129 | ADI-58128 | LA |
| ADI-58131 | ADI-58130 | LA |
| ADI-58130_LCN30cQ | ADI-58130_LCN30cQ | WT |
| ADI-59988 | ADI-58130_LCN30cQ | LA |
| ADI-58128 | ADI-58128 | WT |

Example 22: Affinity of Post-Affinity Maturation Antibodies

Figure 37A:
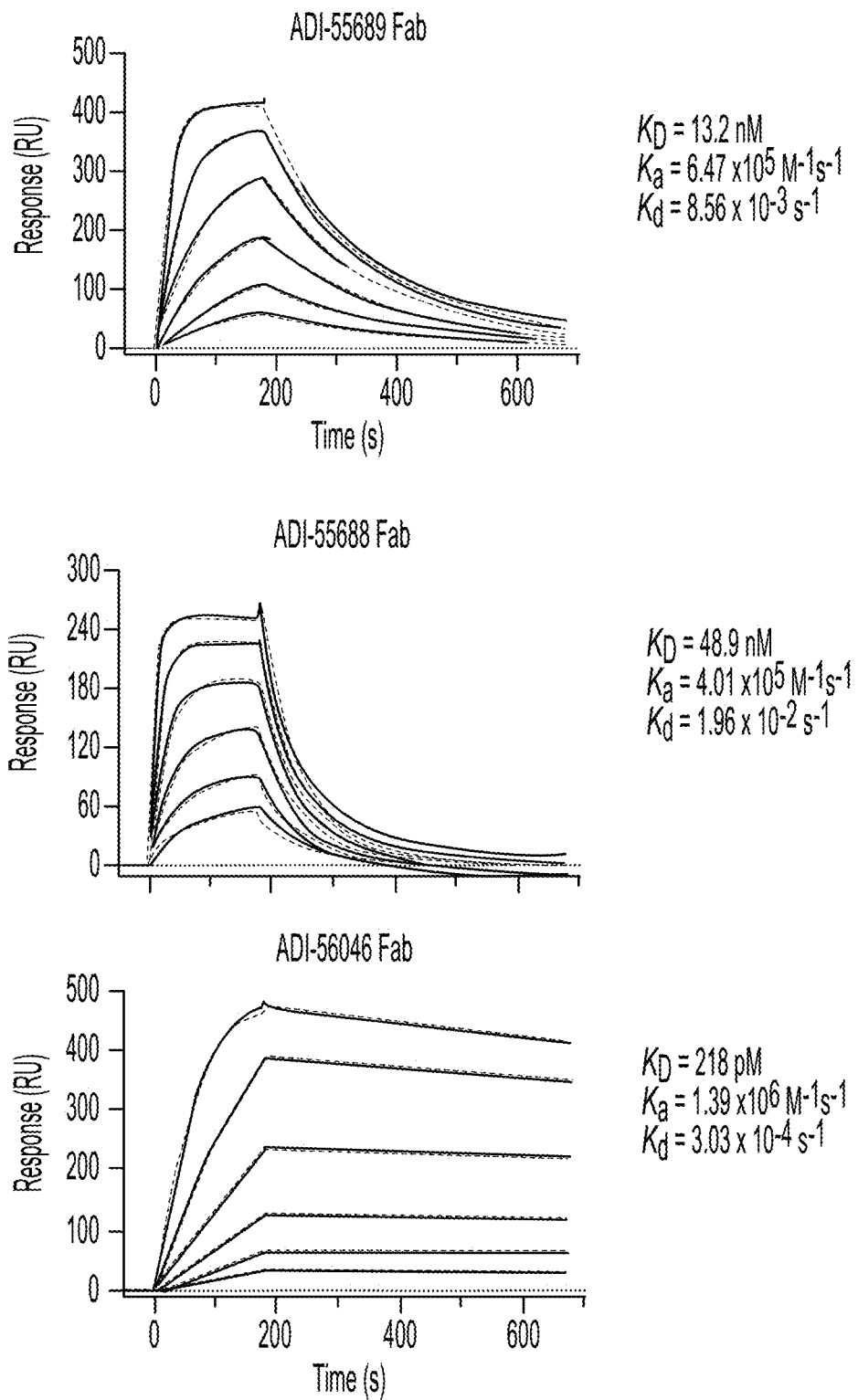
FIG. 37A provides exemplary binding kinetics of pre-affinity maturation antibodies (ADI-55689, ADI-55688, and ADI-56046) and post-affinity maturation antibodies derived therefrom, respectively, after fixing primer mutations (ADI-58120, ADI-58124, and ADI-58126). The SPR sensorgrams show binding of each Fab to SARS-CoV-2 RBD-SD1. Binding data are shown as black lines and the best fit of a 1:1 binding model is shown as red lines.
Figure 37A:
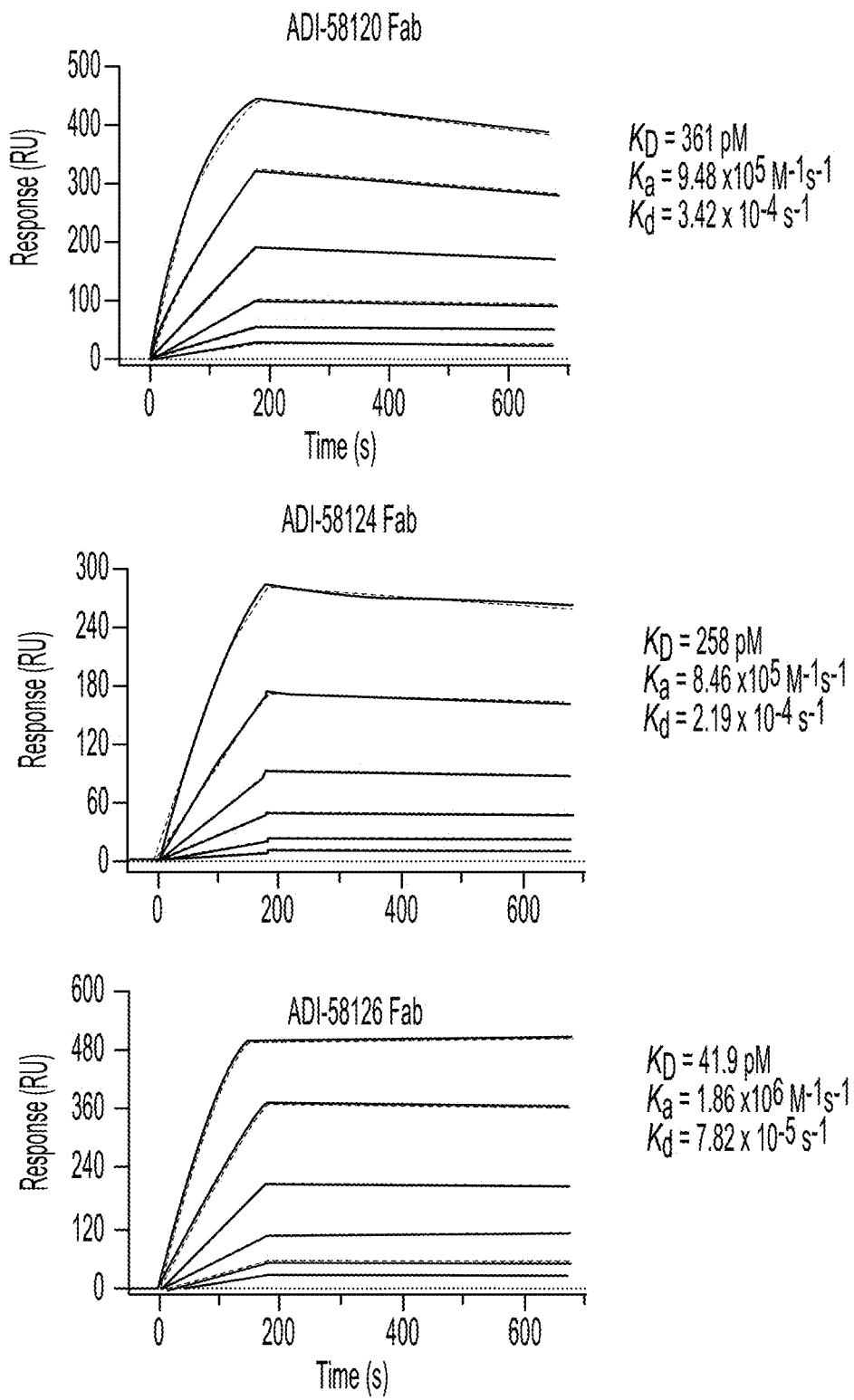

The affinity of ADI-58120, ADI-58124, and ADI-58126 to SARS-CoV-2 RBD-SD1 (SD1 is the subdomain 1) and the respective parent antibodies before affinity maturation was measured using SPR as described below. As shown in FIG. 37A, the post-affinity maturation antibodies showed 25 to 630-fold improvements in binding relative to their respective parental antibodies.

The affinity of ADI-58124 and its parental antibodies (before and after affinity maturation) expressed as Fab to SARS-CoV-2 S protein, measured by BLI, is shown in FIG. 37B.

The affinity of ADI-58125 expressed as IgG or Fab to SARS-CoV-2 S protein, SARS-CoV-2 S protein RBD, SARS-CoV S protein, SARS-CoV S protein RBD, and WIV-1 S protein RBD was also measured via SPR as described below. Binding kinetics results are summarized in FIG. 37C.

A brief description of methods used is provided below.

Expression and Purification of IgGs and Fab Fragments:

Monoclonal antibodies were produced as full-length IgG1s in *S. cerevisiae* cultures, as described in Wec A. et al., Science. Jun. 15, 2020; eabc7424. Briefly, yeast cultures were incubated in 24-well plates placed in Infors Multitron shaking incubators at 30° C., 650 rpm and 80% relative humidity. After 6 days, the supernatants containing the IgGs were harvested by centrifugation and purified by protein A-affinity chromatography. The bound IgGs were eluted with 200 mM acetic acid/50 mM NaCl (pH 3.5) into ⅛th volume 2 M Hepes (pH 8.0) and buffer-exchanged into PBS (pH 7.0).

Fab fragments for structural studies were also generated as described in Wec A. et al., Science. Jun. 15, 2020; eabc7424. Briefly, IgGs were digested with papain for 2 hours at 30° C. followed by addition of iodoacetamide to terminate the digestion. To remove the Fc fragments and any undigested IgG fractions, the mixtures were passed over Protein A agarose. The flow-through of the Protein A resin was then passed over CaptureSelect™ IgG-CH1 affinity resin (ThermoFisher Scientific) and the captured Fabs were eluted with 200 mM acetic acid/50 mM NaCl (pH 3.5) into ⅛th volume 2 M Hepes (pH 8.0) followed by buffer exchange into PBS (pH 7.0).

Surface Plasmon Resonance (SPR) Fab Kinetic Binding Measurements:

SEC-purified SARS-CoV-2 RBD-SD 1 was immobilized to a NiNTA sensor chip in a Biacore X100 (GE Life Sciences) to a response level of ~500 RUs. Fabs were then injected at increasing concentrations, ranging from 18.75-300 nM (ADI-55688), 1.56-25 nM (ADI-56046), 6.25-100 nM (ADI-55689), or 1.25-20 nM (ADI-58120, ADI-58124, ADI-58126). The sensor chip was doubly regenerated between cycles using 0.35 M EDTA and 0.1 M NaOH. The resulting data were double reference subtracted and fit to a 1:1 binding model using Biacore Evaluation Software.

In the next several examples, ADI-58120, ADI-58124, ADI-58126, ADI-58128, ADI-58130, and/or ADI-58130-LCN30cQ, and/or their variants comprising a non-wild-type Fc region were compared with antibodies in the clinic that are specific to SARS-CoV-2. Table 3 provides the sequences of VH, $V_L$, HC, and LC, respectively, of anti-SARS-CoV-2 antibodies currently under clinical trials.

TABLE 3

Sequences for Clinical Antibodies

| Antibody name | VH | VL | HC | Fc variant | LC | LC Class |
|---|---|---|---|---|---|---|
| S309 | SEQ ID NO: 22 | SEQ ID NO: 32 | SEQ ID NO: 21 | LS | SEQ ID NO: 31 | kappa |
| REGN10987 | SEQ ID NO: 42 | SEQ ID NO: 52 | SEQ ID NO: 41 | WT-DEL | SEQ ID NO: 51 | lambda |
| REGN10933 | SEQ ID NO: 62 | SEQ ID NO: 62 | SEQ ID NO: 61 | WT-DEL | SEQ ID NO: 61 | kappa |
| JS016 | SEQ ID NO: 82 | SEQ ID NO: 92 | SEQ ID NO: 81 | LALA-DEL | SEQ ID NO: 91 | kappa |

Example 23: Antibody Developability of Post-Affinity Maturation Antibodies

Figure 38A:
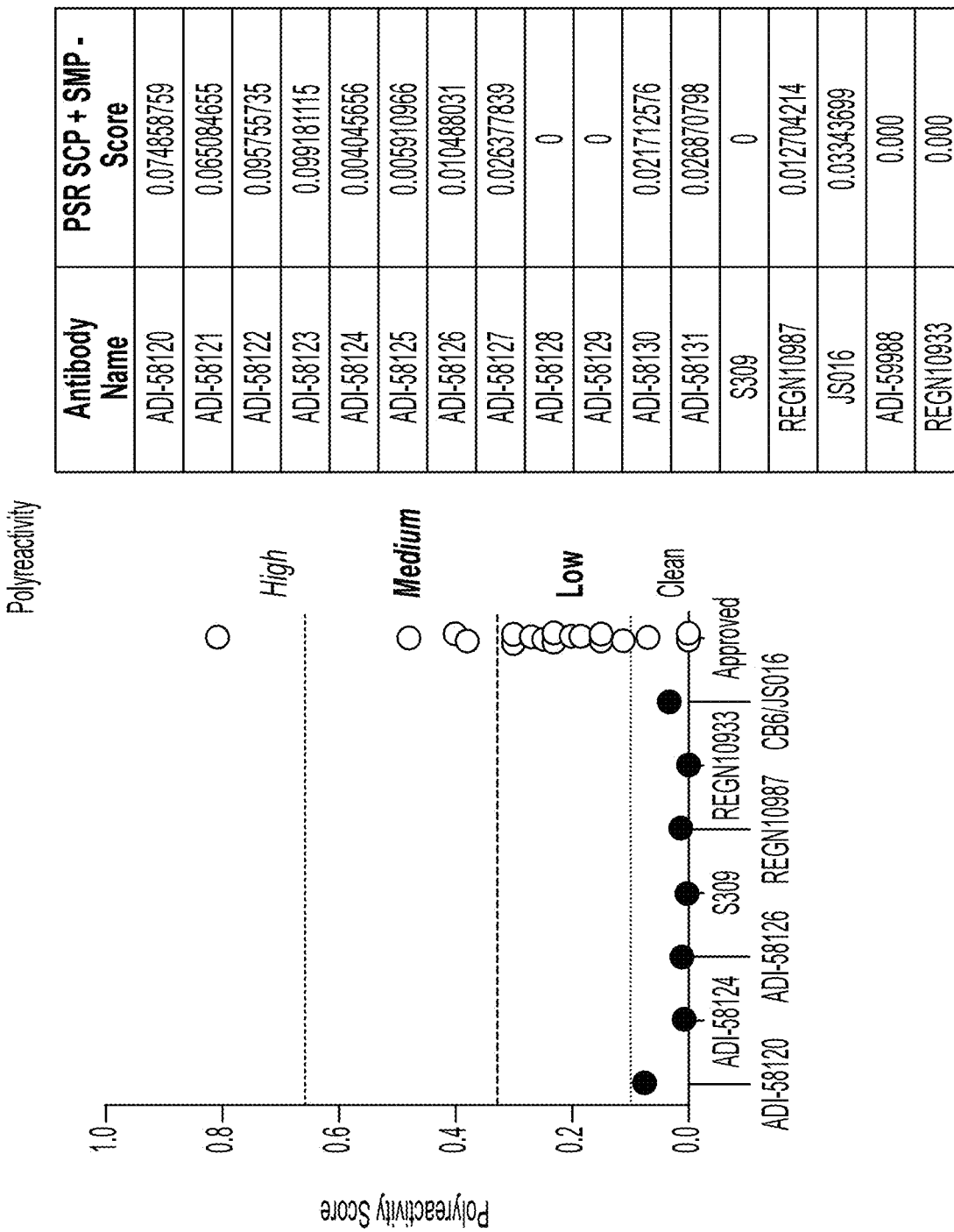
FIGS. 38A-38D compare biophysical properties of antibodies according to the present disclosure, anti-SARS-CoV-2 antibodies currently under clinical trials, and 42 clinically approved antibodies (Jain T. et al., Proc Natl Acad Sci USA. Jan. 31, 2017; 114(5):944-949).
Figure 38B:
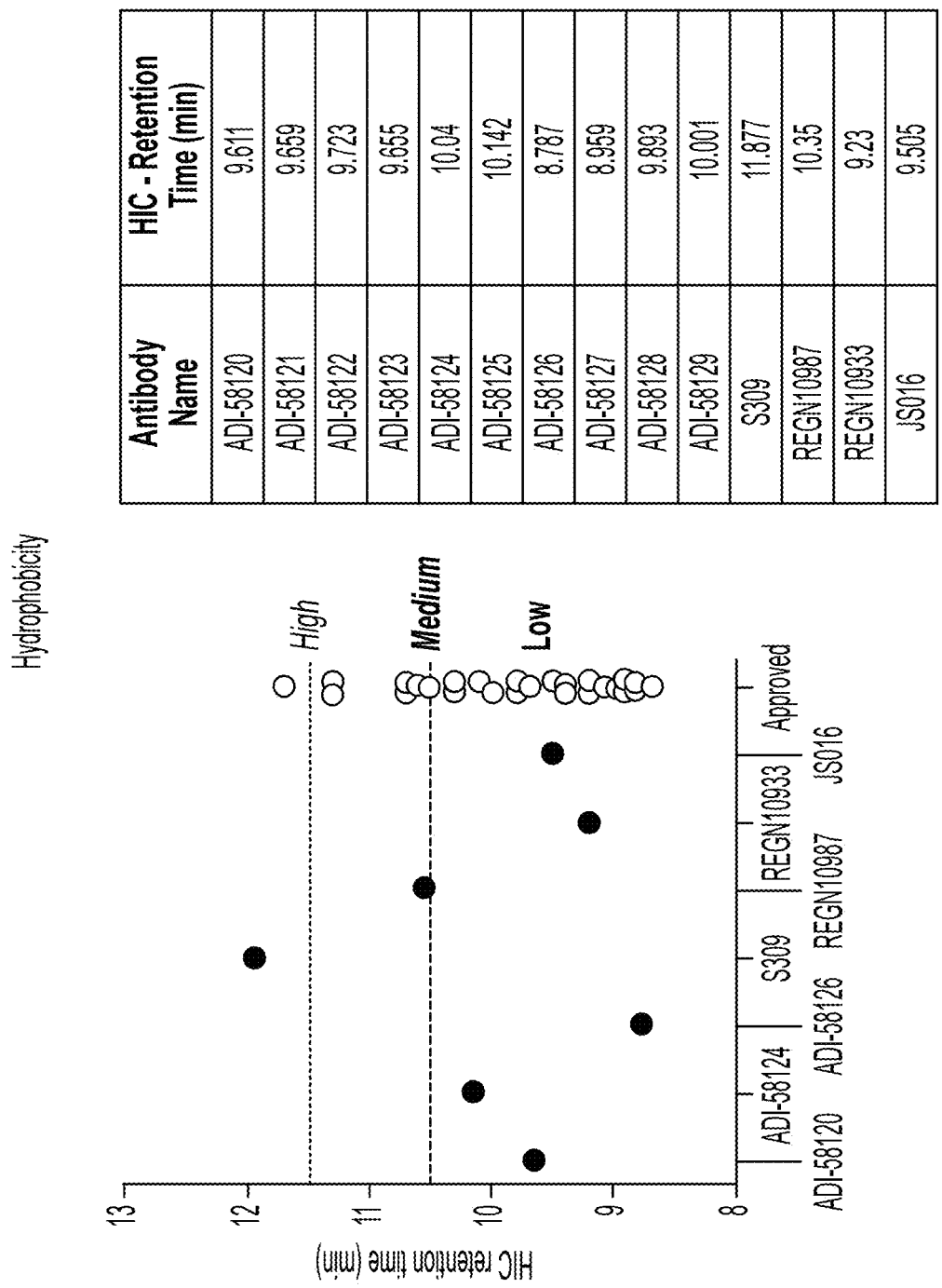
Figure 38C:
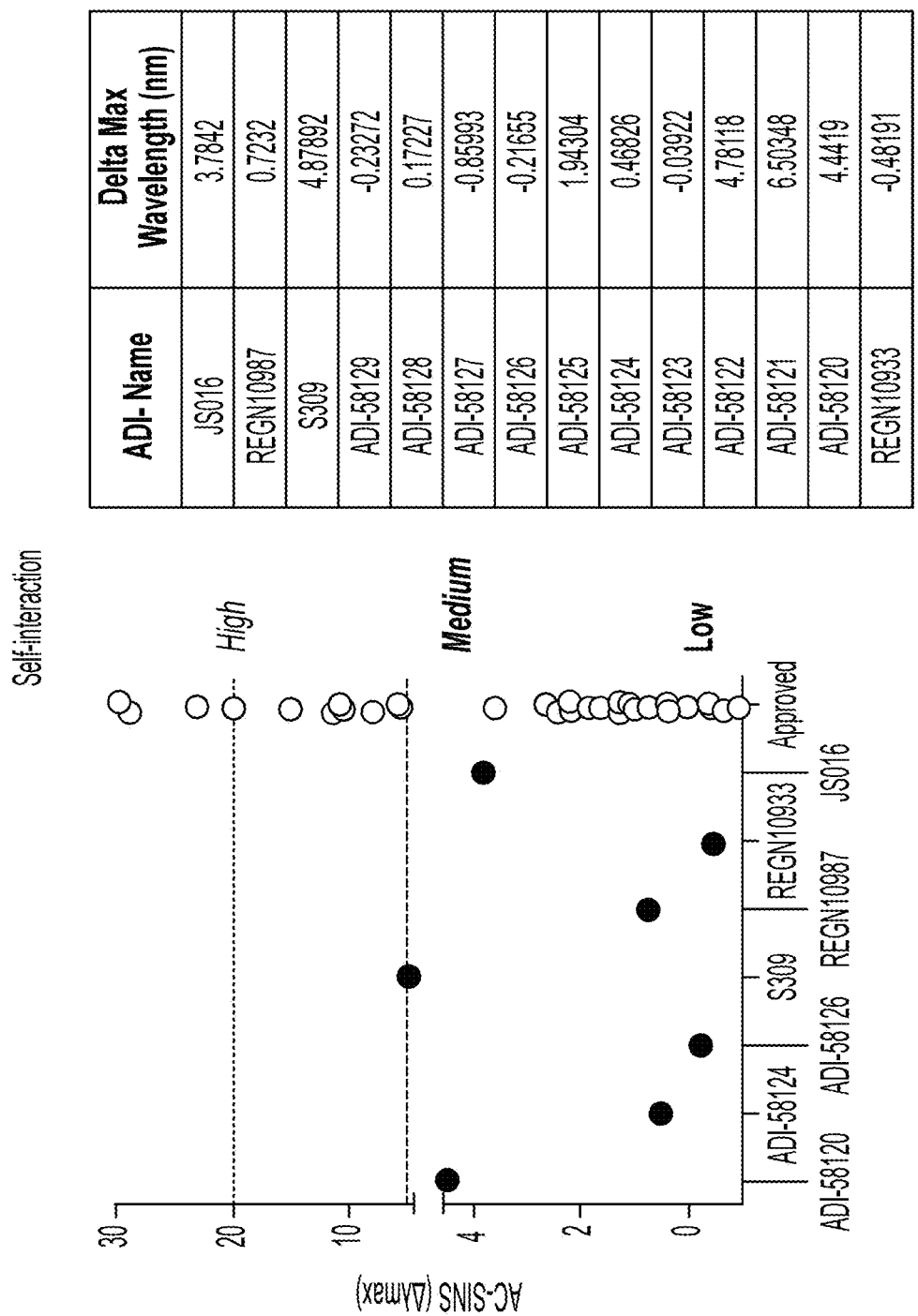
Figure 38D:
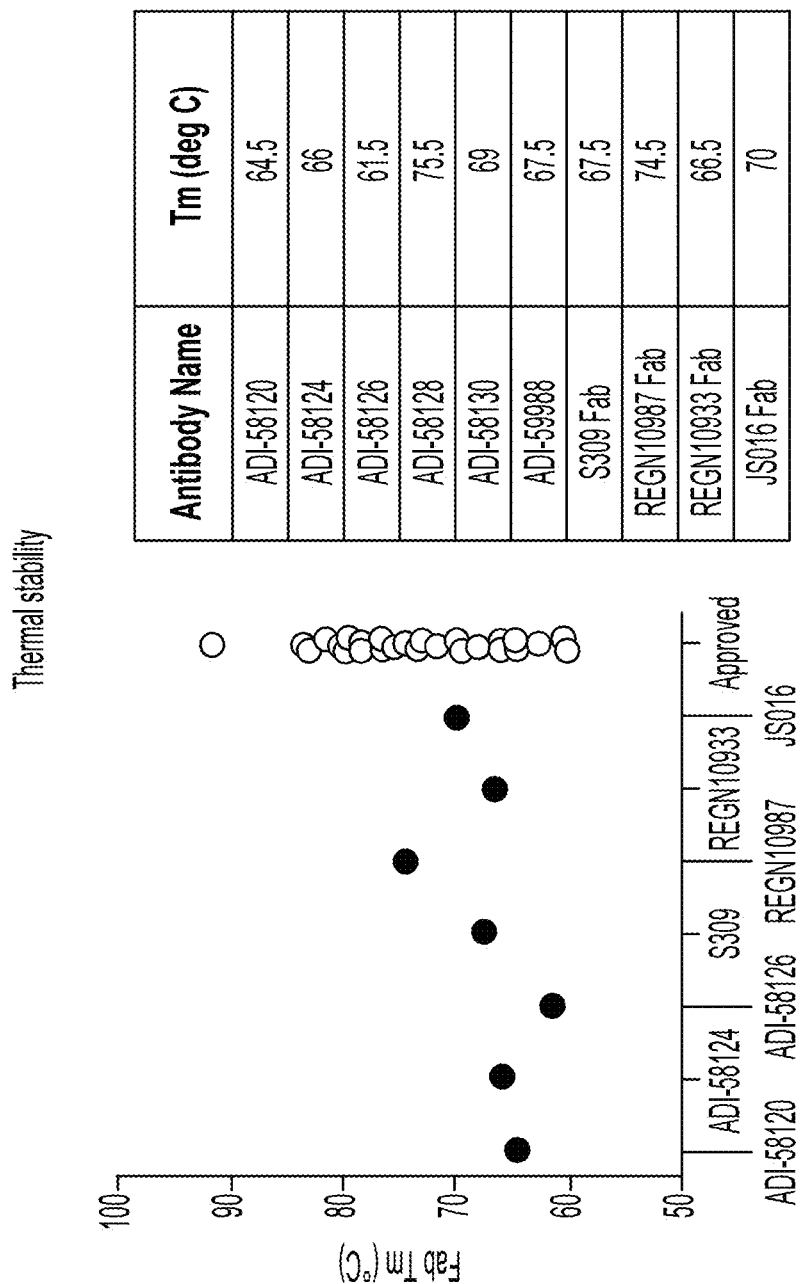

Because in vitro engineering can lead to polyspecificity with potential risks of off-target binding and accelerated clearance in vivo (S. A. Sievers, et al., Curr Opin HIV AIDS 10, 151-159 (2015)), we assessed the polyspecificity of ADI-58120, ADI-58124, ADI-58126, ADI-58128, and ADI-581230, and Fc variants thereof using a previously described assay that has been shown to be predictive of serum-half life in humans (L. Shehata et al., Cell Rep 28, 3300-3308 e3304 (2019)). All three antibodies lacked polyreactivity in this assay, indicating a low risk for poor pharmacokinetic behavior (FIG. 38A). The three antibodies also showed low hydrophobicity, a low propensity for self-interaction, and thermal stabilities within the range observed for clinically approved antibodies (FIGS. 38A-38D), suggesting that the process of in vitro engineering did not negatively impact biophysical properties that are often linked to down-stream behaviors such as ease of manufacturing, ability to formulate to high concentrations, and long-term stability.

Brief descriptions of the methods used are provided below:

Polyreactivity Assay:

Polyspecificity reagent binding of antibodies was performed as described previously (8). Briefly, soluble membrane protein (SMP) and soluble cytosolic protein (SCP) fractions were extracted from Chinese hamster ovary (CHO) cells and biotinylated using NHS-LC-Biotin (Thermo Fisher Scientific) reagent. Yeast-presented IgGs were incubated with 1:10 diluted stock of biotinylated SMP and SCP for 20 minutes on ice, followed by two washes with PBSF, and stained with 50 µl of the secondary labelling mix containing ExtrAvidin-R-PE (Sigma-Aldrich), anti-human LC-FITC (Southern Biotech), and propidium iodide (Invitrogen) for 15 minutes on ice. Cells were subsequently washed out of secondary reagents with PBSF and resuspended in PBSF for flow cytometric analysis on a BD FACS Canto II (BD Biosciences).

Affinity-Capture Self-Interaction Nanoparticle Spectroscopy (AC-SINS):

To measure the propensity for antibodies to self-associate, AC-SINS was performed based on a previously described protocol (Liu Y et al., MAbs. March-April 2014; 6(2):483-92). Briefly, polyclonal goat anti-human IgG Fc antibodies (capture; Jackson ImmunoResearch Laboratories) and polyclonal goat non-specific antibodies (non-capture; Jackson ImmunoResearch Laboratories) were buffer exchanged into 20 mM sodium acetate (pH 4.3) and concentrated to 0.4 mg/ml. A 4:1 volume ratio of capture:non-capture was prepared and further incubated at a 1:9 volume ratio with 20 nm gold nanoparticles (AuNP; Ted Pella Inc.) for 1 hour at room temperature. Thiolated PEG (Sigma-Aldrich) was then used to block empty sites on the AuNP and filtered via a 0.22 µm PVDF membrane (Millipore). Coated particles were subsequently added to the test antibody solution and incubated for 2 hours at room temperature before measuring absorbance from 510 to 570 nm on a plate reader. Data points were fit with a second-order polynomial in Excel to obtain wavelengths at maximum absorbance. Values are reported as the difference between plasmon wavelengths of the sample and background (Δλmax).

Fab Melting Temperature:

Apparent melting temperatures (TmApp) of Fab fragments were obtained as previously described (He F. et al., J Pharm Sci. 2011 December; 100(12):5126-41). Briefly, 20 µl of test antibody solution at 1 mg/ml was mixed with 10 µl of 20xSYPRO orange. The plate was scanned with a CFX96 Real-Time System (BioRad) from 40° C. to 95° C. at a rate of 0.25° C. per minute. TmApp was calculated from the primary derivative of the raw data via the BioRad analysis software.

Hydrophobic Interaction Chromatography (HIC):

Antibody hydrophobicity was evaluated using HIC as previously described (Estep P. et al., MAbs. 2015; 7(3):553-61). Test antibody samples were diluted in phase A solution (1.8 M ammonium sulfate and 0.1 M pH 6.5 sodium phosphate) to a final concentration of 1.0 M ammonium sulfate. A linear gradient from phase A solution to phase B solution (0.1 M pH 6.5 sodium phosphate) was run for 20 minutes at a flow rate of 1.0 ml/min using the Sepax Proteomix HIC butyl-NP5 column Peak retention times were obtained from monitoring UV absorbance at 280 nm.

Example 24: Neutralization Potential of Post-Affinity Maturation Antibodies

Figure 39A:
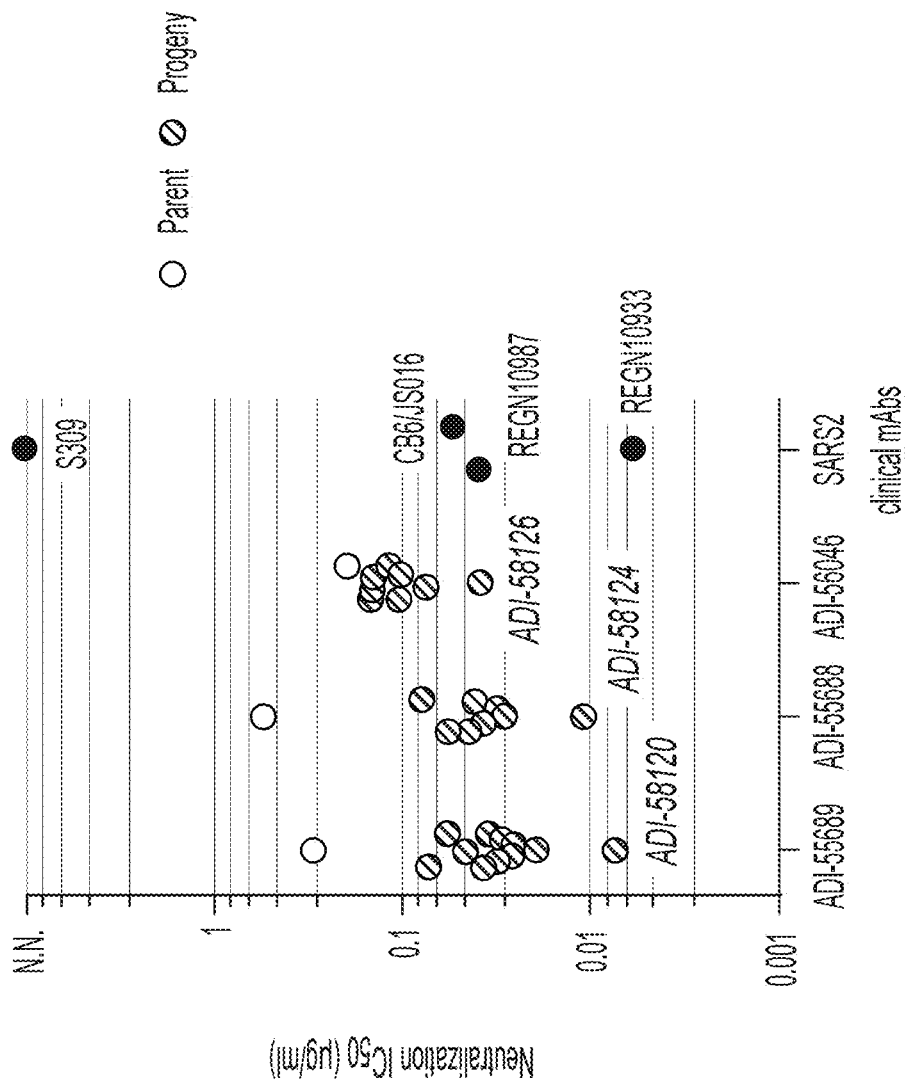
FIGS. 39A-39F compares neutralization of different coronaviruses and pseudoviruses by ADI-58124 and its parent ADI-55688, and anti-SARS-CoV-2 antibodies currently under clinical trials.

To determine whether the improvements in SARS-CoV-2 S binding affinity translated into enhanced neutralization potency, we selected between 9 and 14 affinity-matured progeny from each lineage (including ADI-58120, ADI-58124, and ADI-58126) and evaluated them for SARS-CoV-2 neutralizing activity in a murine leukemia virus (MLV) pseudovirus assay (T. Giroglou, et al., *J Virol* 78, 9007-9015 (2004)). The neutralizing activities of several clinical neutralizing antibodies (nAbs) were also measured (5309, REGN10933, REGN10987, and CB6/JS016) as benchmarks (D. Pinto et al., *Nature* 583, 290-295 (2020); R. Shi et al., *Nature* 584, 120-124 (2020); J. Hansen et al., *Science* 369, 1010-1014 (2020)). All of the affinity matured antibodies showed improved neutralizing activity relative to their parental clones, and the most potent neutralizers from each lineage (ADI-58120, ADI-58124, and ADI-58126) displayed neutralization IC50s that were comparable to or lower than those observed for the clinical SARS-CoV-2 nAb controls (FIG. 39A).

Example 25: Neutralization Breadth of Post-Affinity Maturation Antibodies

To determine whether the process of SARS-CoV-2 affinity engineering impacted neutralization breadth, ADI-58120, ADI-58124, and ADI-58126, as well as their respective parental antibodies, were evaluated for neutralizing activity against a panel of representative authentic clade I sarbecoviruses (SARS-CoV, SHC014, SARS-CoV-2, and WIV-1). Consistent with the MLV-SARS-CoV-2 assay results, ADI-58124 displayed highly potent neutralizing activity against authentic SARS-CoV-2, with an IC50 comparable to or lower than that observed for the clinical SARS-CoV-2 nAbs (FIGS. 39B-39D). Furthermore, in contrast to the clinical nAbs, ADI-58124 also displayed remarkable neutralization potency against SARS-CoV and the two SARS-related bat viruses, with IC50s between 4-8 ng/ml (FIGS. 39B-39D). Notably, ADI-58126 and the clinical nAb 5309 also cross-neutralized all four sarbecoviruses, but with markedly lower potency than ADI-58124. Finally, ADI-58120 potently neutralized SARS-CoV-2, SARS-CoV, and WIV1, but it lacked activity against SHC014.

Based on its potent cross-neutralization and favorable biophysical properties, ADI-58124 and ADI-58125 were selected for further assessing its neutralizing activity in two alternative authentic SARS-CoV-2 neutralization assays, which confirmed its high potency (IC50~1 ng/ml) (FIGS. 39B-39E, FIG. 39N and FIG. 39O). Interestingly, ADI-58124, ADI-58125, CB6/JS016, REGN10987 and REGN10933 reached 100% neutralization on both Vero and HeLa-ACE2 target cells in this assay, whereas 5309 showed complete neutralization on Vero target cells but plateaued at approximately 40% neutralization on HeLa-ACE2 target cells (FIGS. 39E and 39O). 5309 also failed to neutralize MLV-SARS-CoV-2 on HeLa-ACE2 target cells (FIG. 39A). The reason for this is unclear but may relate to glycan heterogeneity within the 5309 epitope (D. Pinto et al., Nature 583, 290-295 (2020)) coupled with differences in receptor expression or protease cleavage efficiency between the two types of target cells (T. F. Rogers et al., *Science* 21, 956-963 (2020)). Because SARS-CoV-2 D614G has emerged as the dominant pandemic form (B. Korber et al., *Cell* 182, 812-827 e819 (2020)), ADI-58124 was also evaluated for neutralizing activity against this variant in the MLV pseudovirus assay. As expected, based on the location of the D614G substitution outside of the RBD, ADI-58124 neutralized the D614G variant with equivalent potency as wild-type (WT) SARS-CoV-2 (FIG. 39F).

Neutralization of authentic and pseudo coronaviruses by ADI-58120, ADI-58124, and ADI-58126, and/or their variants having a non-wild type Fc are provided in FIGS. 39G-M.

Brief description of methods used is provided below.

HeLa-hACE2 Stable Cell Line:

Stable human ACE2 (hACE2)-expressing HeLa cells for authentic SARS-CoV-2 neutralization assays were generated as previously described (Wec A. et al., Science. Jun. 15, 2020; eabc7424). Briefly, hACE2 (NM_001371415) was cloned into pBOB and co-transfected with lentiviral vectors pMDL (Addgene #12251), pREV (Addgene #12253), and pVSV-G (Addgene #8454) into HEK293T cells using Lipofectamine 2000 (Thermo Fisher Scientific) according to the manufacturer's protocol. Culture media was exchanged 16 hours post-transfection, and supernatant containing hACE2 lentiviruses was harvested 32 hours post-transfection. Pre-seeded HeLa cells were transduced using harvested supernatant with 10 μg/ml polybrene (Sigma). At 12 hours post-transduction, cell surface expression was confirmed by flow cytometry using SARS-CoV-2 S-based probes.

Generation of Authentic SARS-CoV Virus and Neutralization Assay:

To generate authentic SARS-CoV virus, Vero African grivet monkey kidney cells (Vero E6, ATCC-CRL1586) were grown in Dulbecco's Modified Eagle Medium (DMEM high glucose; Gibco, Cat. #11995065), 2% heat-inactivated fetal bovine serum (FBS, Atlanta Biologicals), 0.05% Trypsin-EDTA solution (Gibco), 1% PS (Gibco), and 1% GlutaMAX (Gibco). Vero E6 cells were infected with SARS-CoV/Urbani (MOI=0.01) and incubated at the following conditions: 37° C., 5% $CO_2$ and 80% relative humidity (RH). At 50 hours post-infection, cells were frozen at −80° C. for 1 hour and then thawed at room temperature. The supernatant was collected and clarified by centrifugation at 2500×g for 10 minutes before aliquoting for storage at −80° C.

Virus neutralization was assessed as previously described (Wec A. et al., Science. Jun. 15, 2020; eabc7424. doi: 10.1126/science.abc7424). Briefly, SARS-CoV/Urbani (MOI=0.2) was added to serial dilutions of antibodies and incubated for 1 hour at room temperature. The antibody-virus mixture was added to monolayers of Vero E6 cells in a 96-well plate and incubated for 1 hour at 37° C., 5% $CO_2$ and 80% RH. Next, media was exchanged by washing cells once with 1× PBS and adding fresh cell culture media. At 24-hour post-infection, cells were washed out of media with 1× PBS to then be treated with formalin fixing solution, permeabilized with 0.2% Triton-X for 10 minutes at room temperature, and finally treated with blocking solution. Fixed and permeabilized cells were first stained with a primary antibody recognizing SARS-CoV nucleocapsid protein (Sino Biological), followed by secondary antibody staining with AlexaFluor 488-conjugated goat anti-rabbit antibody. Infected cells were enumerated by an Operetta high content imaging instrument and data was analyzed using the Harmony software (Perkin Elmer).

Generation of MLV Pseudovirus Displaying SARS-CoV-2 WT and D614G S and Neutralization Assay:

To generate the MLV pseudoviruses, pCDNA3.3 plasmids (Thermo Fisher) encoding codon-optimized sequences of the SARS-CoV-2 wildtype (WT; NC_045512) and the D614G variant spike genes (IDT), both with a 28 amino acid deletion in the C-terminal; a luciferase reporter gene plasmid (Addgene #18760) modified with a CMV promoter to replace the IRES; and the MLV Gag-Pol plasmid (Addgene #14887) were purified using the Endo-Free Plasmid Maxi Kit (Qiagen). To generate single-round infection competent pseudoviruses, HEK293T cells were co-transfected with 2 µg of MLV Gag-Pol, 2 µg of MLV luciferase, and 0.5 µg of either SARS-CoV-2 WT S or SARS-CoV-2 D614G S in 6-well plates using Lipofectamine 2000 (Thermo Fisher Scientific) according to the manufacturer's directions. Cell culture media was exchanged 16 hours post-transfection. At 48 hours post-transfection, the supernatant containing SARS-CoV-2 S-pseudotyped viral particles was harvested, aliquoted, and frozen at −80° C.

Antibody neutralization of MLV-based SARS-CoV-2 WT and D614G pseudoviruses was assessed via monitoring infection of HeLa-hACE2 cells by these pseudoviruses using a luminescence assay as previously described (Sarzotti-Kelsoe M. et al., *J Immunol Methods*. 2014 July; 409:131-46) with minor modifications. SARS-CoV-2 WT or D614G pseudotyped MLV vector was mixed with serially diluted antibodies, incubated for 1 hour at 37° C., and followed by addition of 10,000 HeLa-hACE2 cells. Infection was allowed to occur for 42 to 48 hours at 37° C. HeLa-hACE2 cells were subsequently lysed using 1× luciferase lysis buffer (25 mM Gly-Gly pH 7.8, 15 mM MgSO4, 4 mM EGTA, 1% Triton X-100). Luciferase intensity was measured with a luminometer using Bright-Glo luciferase substrate (Promega, PR-E2620) following manufacturer's directions. Percentage of neutralization was calculated as 100*(1-[Relative units of light (RUL) of sample Average RULs of background]/[Average R ULs of virus-only control-Average R ULs of background]).

Generation of Nano-Luciferase (nLuc) Virus by CoV Reverse Genetics:

Mouse-adapted SARS-CoV-1 (MA15), mouse adapted SARS-CoV-2 (MA2) and wildtype SARS-CoV-2 nano-luciferase (nLuc) viruses were generated by CoV reverse genetics as described previously (Hou Y. J. et al., *Cell*. 2020 Jul. 23; 182(2):429-446.e14). WIV-1-nluc and SHC014-nluc were generated by replacing ORF7 and 8 with nLuc. nLuc viruses were subsequently used in luciferase-based antibody neutralization assays on Vero E6 target cells as described below.

Authentic SARS-CoV-2, WIV-1, and SHC014 Nano-Luciferase Neutralization Assays:

Vero E6 cells were grown in DMEM high glucose media (Gibco Cat. #11995065) supplemented with 10% fetal clone II (GE Cat. #SH3006603H1)+1% non-essential amino acid and 1% Pen/Strep (growth media) at 37° C., 5% $CO_2$. Vero E6 cells were seeded at $2 \times 10^4$ cells/well in a black-wall, tissue culture treated, 96-well plate (Corning, Cat #3603) 24 h before the assay. A pre-determined amount of plaque-forming units (PFU) from a viral titration curve was diluted in growth media. Antibodies were diluted in growth media to obtain an 8-point, 3-fold dilution curve with starting concentration at either 15, 7.5, 3.75 or 0.74 µg/ml. SARS1-MA15-nLuc (75 Pfu/well), SARS2-nLuc (100 Pfu/well), SARS2-MA2-nLuc (85 Pfu/well), SHC014-nLuc (20 Pfu/well) and WIV1-nLuc (250 Pfu/well) viruses were mixed with Abs at a 1:1 ratio and incubated at 37° C. for 1 h. Virus and Ab mix was added to each well and incubated at 37° C., 5% CO2 for 48 h (SARS1-MA15, SARS2-MA2 and SARS2-nLuc) or 24 h (SHC014-nLuc and WIV1-nLuc). Luciferase activities were measured by the Nano-Glo Luciferase Assay System (Promega Cat. #N1130) following the manufacturer's protocol using a SpectraMax M3 luminometer (Molecular Device). Percent inhibition was calculated by the following equation: [1-(RLU with sample/RLU with mock treatment)]×100%. Fifty percent inhibition titer (IC50) was calculated in GraphPad Prism 8.3.0 by fitting the data points using a sigmoidal dose-response (variable slope) curve. All the live virus experiments were performed under biosafety level 3 (BSL-3) conditions at negative pressure, by operators in Tyvek suits wearing personal powered-air purifying respirators.

Generation of Authentic SARS-CoV-2 Virus and Neutralization Assays:

Authentic SARS-CoV-2 virus was produced in Vero E6 cells as described previously (Rogers T. F. et al., *Science*. Aug. 21, 2020; 369(6506):956-963). Briefly, Vero E6 cells were grown overnight in complete DMEM (Corning, Cat #15-013-CV) supplemented with 10% FBS, 1× PenStrep (Corning, Cat #C20-002-CL), 2 mM (Corning, Cat #25-005-CL) at 37° C., 5% $CO_2$. Cells were incubated with two ml of SARS-CoV-2 strain USA-WA1/2020 (BEI Resources, Cat #NR-52281) at multiplicity of infection of 0.5 for 30 min at 34° C., 5% CO2, followed by direct addition of 30 ml of complete DMEM. At 5 days post-infection, the supernatant was centrifuged at 1000×g for 5 minutes, filtered using 0.22 µM filters, and frozen at −80° C.

Antibody neutralization against live, replicating, authentic SARS-CoV-2 was assessed using 2 cell-based assays. Vero E6 cells and a HeLa-hACE2 stable cell line were grown in complete DMEM (Corning, Cat #15-013-CV) supplemented with 10% FBS, 1× PenStrep (Corning, Cat #C20-002-CL), 2 mM L-glutamine (Corning, Cat #25-005-CL) at 37° C., 5% CO2. Either HeLa-hACE2 or Vero E6 target cells were seeded in a 96-well half-well plate at approximately 8000 cells/well suspended in 50 µl complete DMEM (Corning, Cat #15-013-CV) and grown overnight. 1000 plaque forming units (PFU)/well of SARS-CoV-2 was added to titrating amounts of antibody and incubated for 30 minutes. The virus-antibody mixture was subsequently incubated with either HeLa-hACE2 or Vero E6 cells for 24 hours at 37° C., 5% CO2. Following incubation, the infection media was removed. Cells were submerged in 4% formaldehyde for 1 hour, followed by three cycles of washing with PBS, and incubated with 100 µl/well of permeabilization buffer (1× PBS with 1% Triton-X) with gentle shaking. The plate was then blocked with 100 µl of 3% w/v bovine serum albumin for 2 hours at room temperature (RT) and subsequently washed out of blocking solution with wash buffer (1× PBS with 0.1% Tween-20).

SARS-CoV-2 viruses on the plate were detected using an antibody mixture consisting of CC6.29, CC6.33, L25-dP06E11, CC12.23, CC12.25, which were derived from convalescent SARS-CoV-2 cohort participants (T. F. Rogers et al., Science 369, 956-963 (2020)). Pooled antibodies were added to wells at a concentration of 2 µg/ml (50 µl/well) and incubated for 2 hours at RT. Cells were subsequently washed 3 times with wash buffer, stained with 0.5 µg/ml peroxidase-conjugated AffiniPure goat anti-human IgG (Jackson ImmunoResearch Laboratories, Inc, Cat #109-035-088) for 2 hours at RT, and followed by 6 washes with wash buffer. HRP substrate (Roche, Ca #11582950001), freshly prepared at a 100:1 volume ratio of Solution A:B, was added to each well. Chemiluminescence was measured using a microplate luminescence reader (BioTek, Synergy 2).

A standard curve of serially diluted virus from 3000 to 1 PFU was plotted against relative light units (RLU) using a 4-parameter logistic regression as follows: $y = a + (b-a)/(1+(x/x_0)^c)$ where y=variable in RLU, x=variable in PFU and a, b, c and $x_0$ are parameters fit by the standard curve. Using parameters generated by the standard curve, sample RLU values were converted into PFU values ($x = x_0 \, x_0 \times \log_c [(b-y)/(y-a)]$), and percentage neutralization was calculated with the following equation: % Neutralization=100×[(VC−

ADI-58124 treated)/(VC−CC), where VC=average of vehicle-treated control and CC=average of cell only control, both variables in PFU values. Fifty percent inhibition titer ($IC_{50}$) values were determined using logistic regression fitting of neutralization curves.

Example 26: Further Neutralization Breadth Evaluation of Post-Affinity Maturation Antibodies Next, the breadth of sarbecovirus recognition by ADI-58124, ADI-58125, and other clinical antibodies was assessed by measuring its apparent binding affinity ($K_D^{APP}$) to a panel of 17 representative sarbecovirus RBDs expressed on the surface of yeast (T. N. Starr et al., Cell 182, 1295-1310 (2020)). ADI-58125 and ADI-58124 share the same CDR sequences and only differ in the Fc region which has been engineered for half-life extension purpose.

Figure 40A:
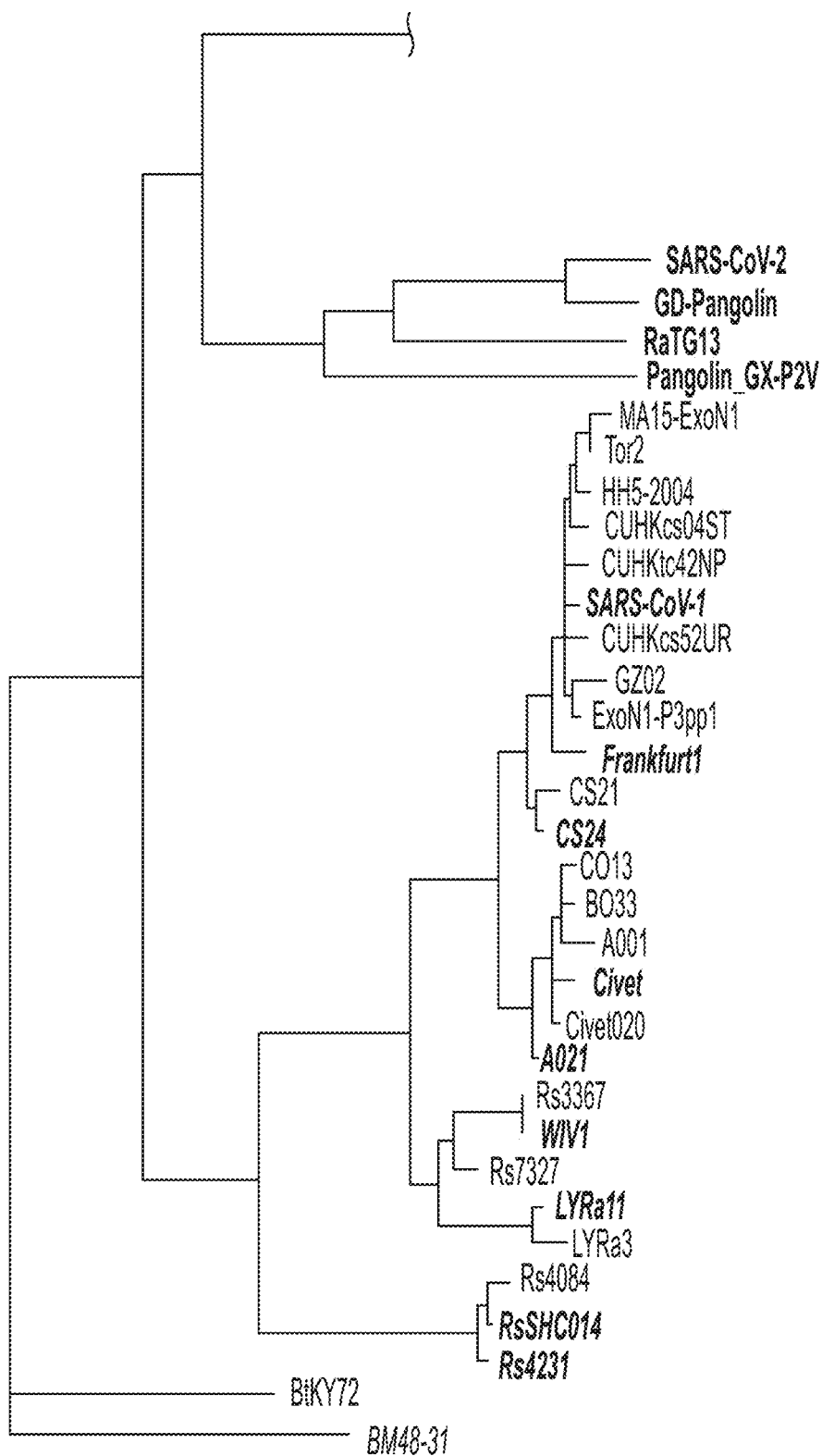
Figure 40A:
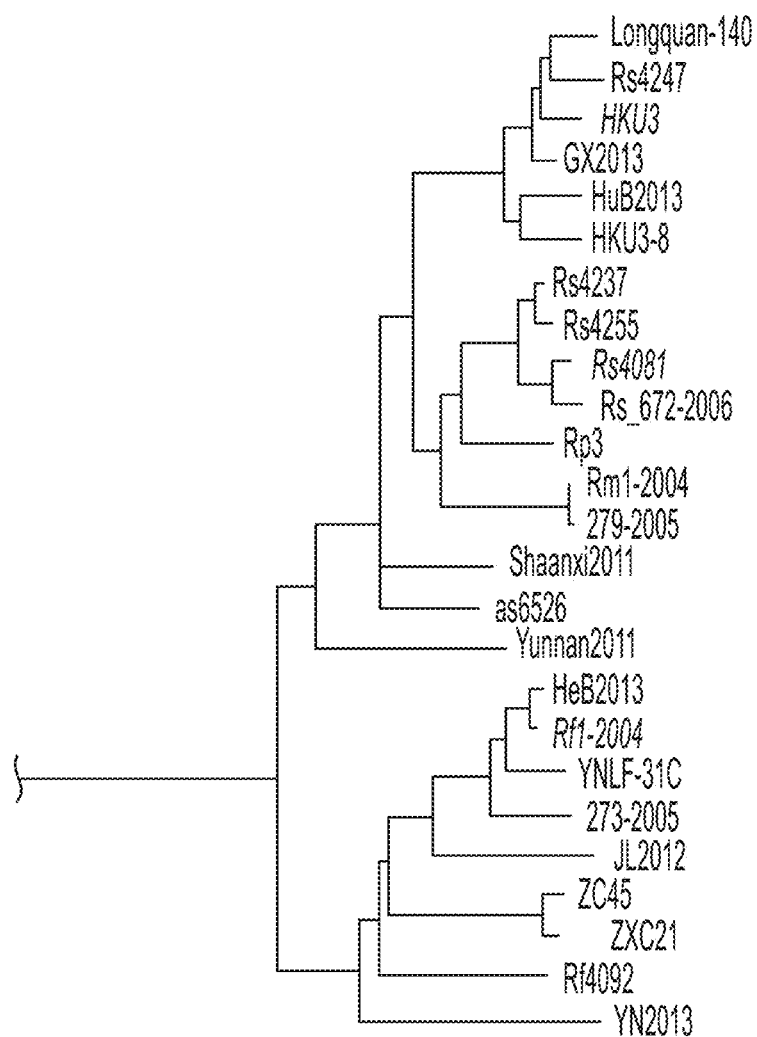
Figure 40B:
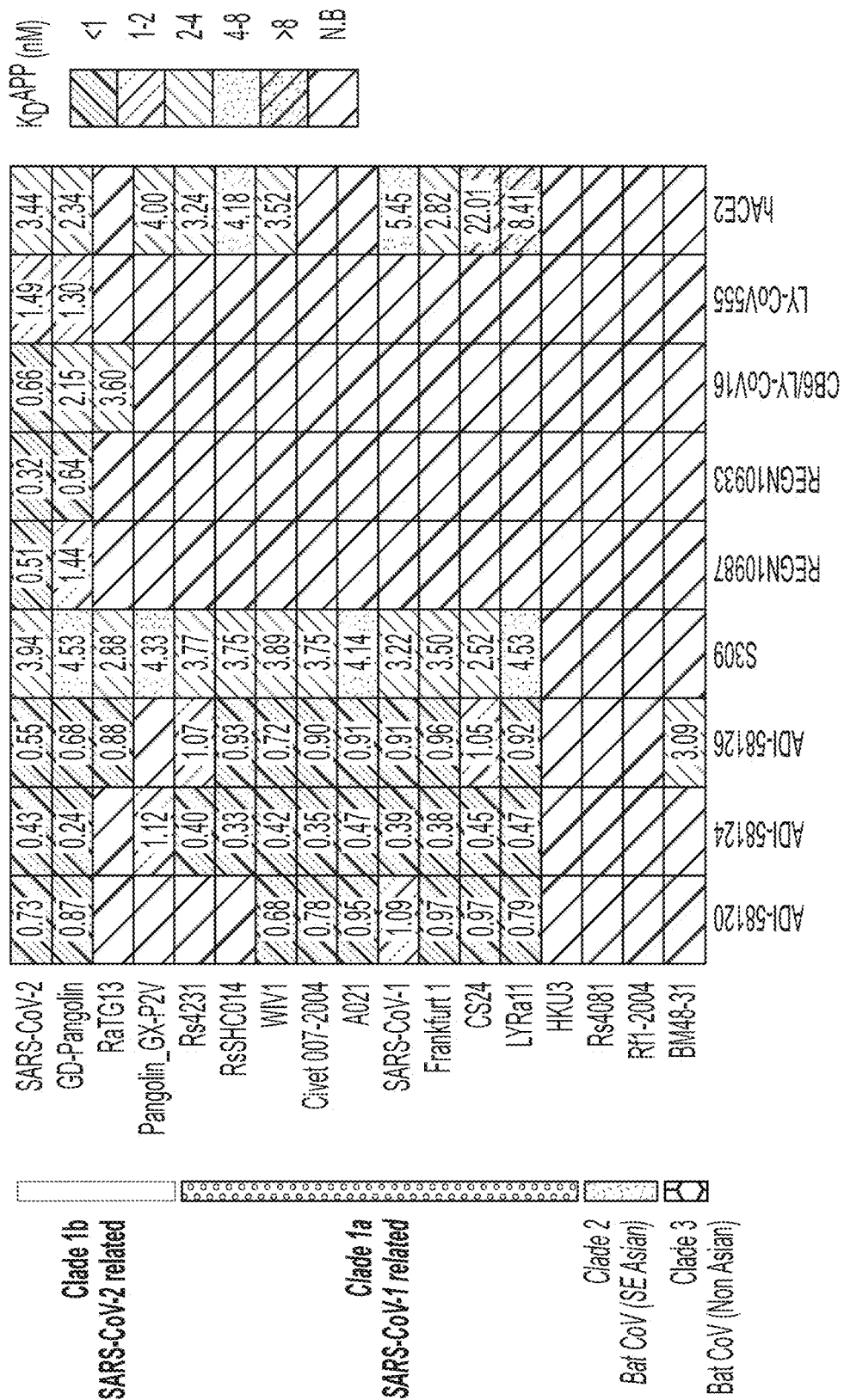

Thirteen viruses were selected from clade I—representing the closest known relatives of SARS-CoV-2 (GD-Pangolin and RaTG13) to the most divergent (SHC014 and Rs4231)—as well as four viruses from the distantly related clades 2 and 3, which do not utilize ACE2 as a host receptor (M. Letko, A. Marzi, V. Munster, Nat Microbial 5, 562-569 (2020)) (FIG. 40A). Recombinant hACE2 and the clinical SARS-CoV-2 nAbs described above were also included as controls. Consistent with previous reports (D. Wrapp et al., Science 367, 1260-1263 (2020); T. N. Starr et al., Cell 182, 1295-1310 (2020)), hACE2 only recognized clade I RBDs and bound with higher affinity to SARS-CoV-2 than SARS-CoV (FIG. 40B). In addition, the clinical SARS-CoV-2 nAbs CB6/JS016, REGN10987, and REGN10933 bound to the SARS-CoV-2 RBD with $K_D^{APPs}$ comparable to published reports (FIG. 40B) (R. Shi et al., Nature 584, 120-124 (2020); J. Hansen et al., Science 369, 1010 1014 (2020)). Notably, S309 displayed diminished binding in this expression platform, likely due to recognition of an epitope containing an N-glycan that may be hyper-mannosylated in yeast (D. Pinto et al., Nature 583, 290-295 (2020)).

Figure 39B:
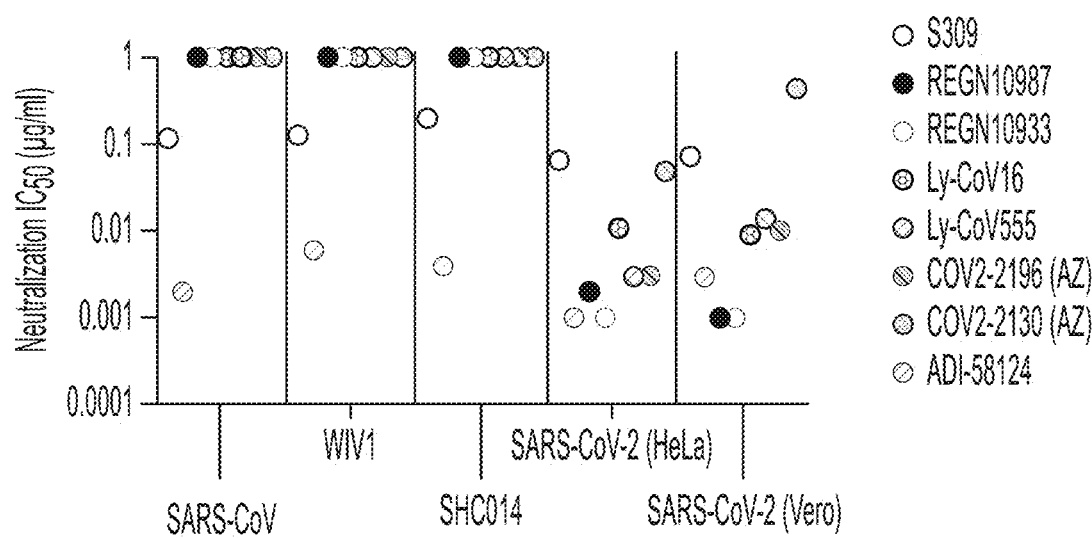
Figure 39C:
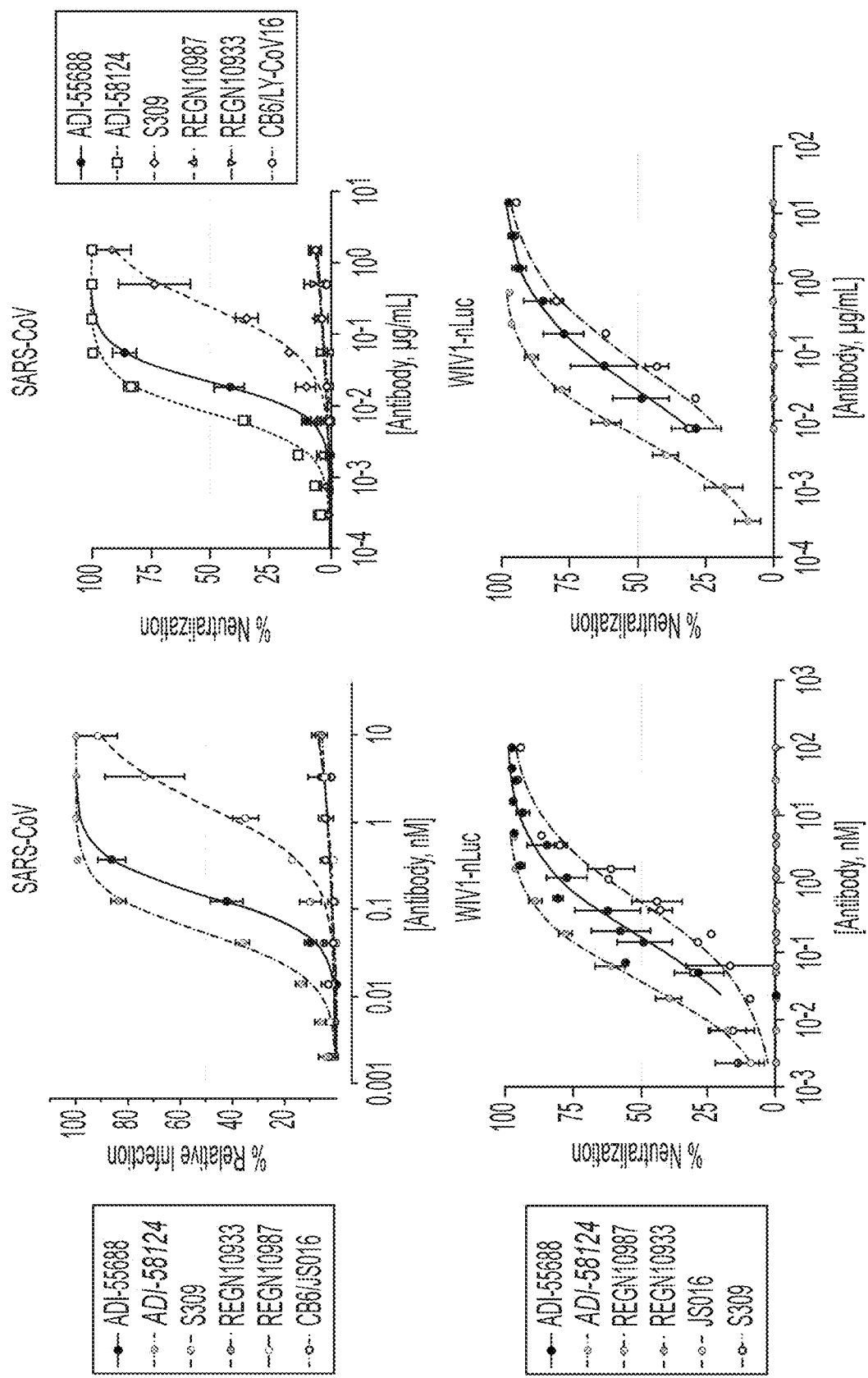
Figure 39D:
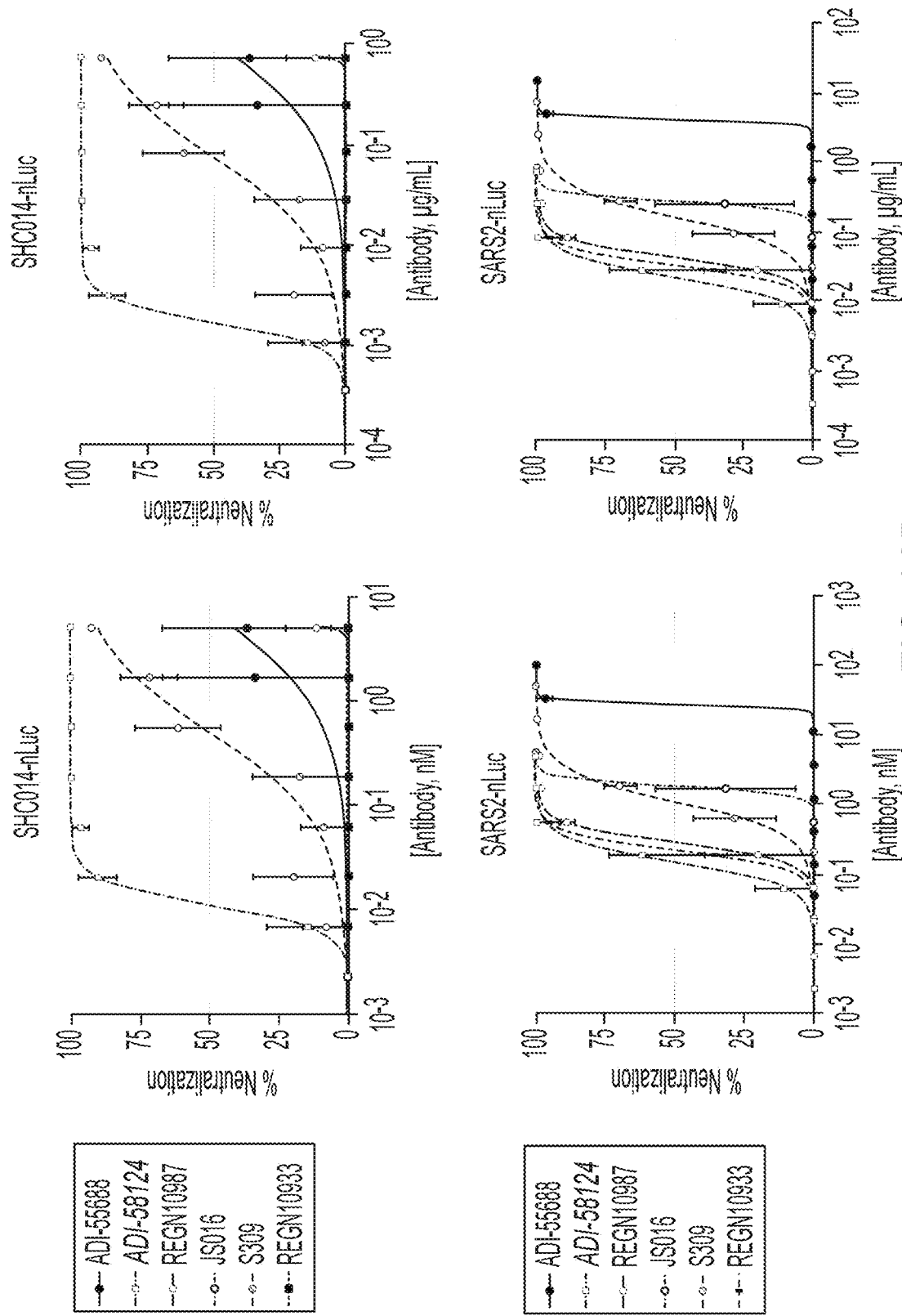
Figure 39E:
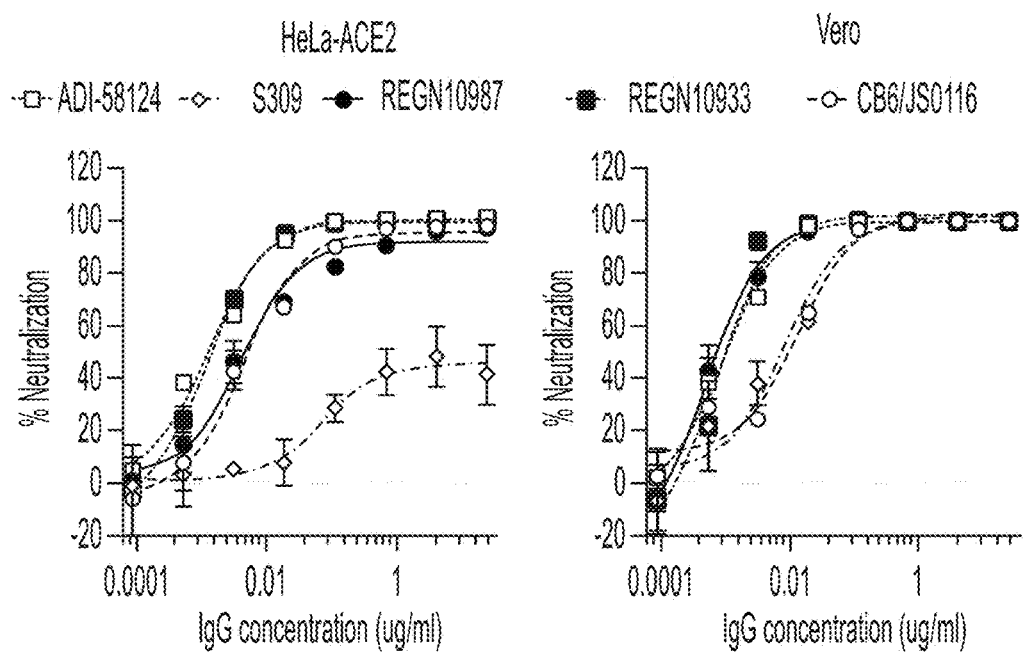
Figure 39F:
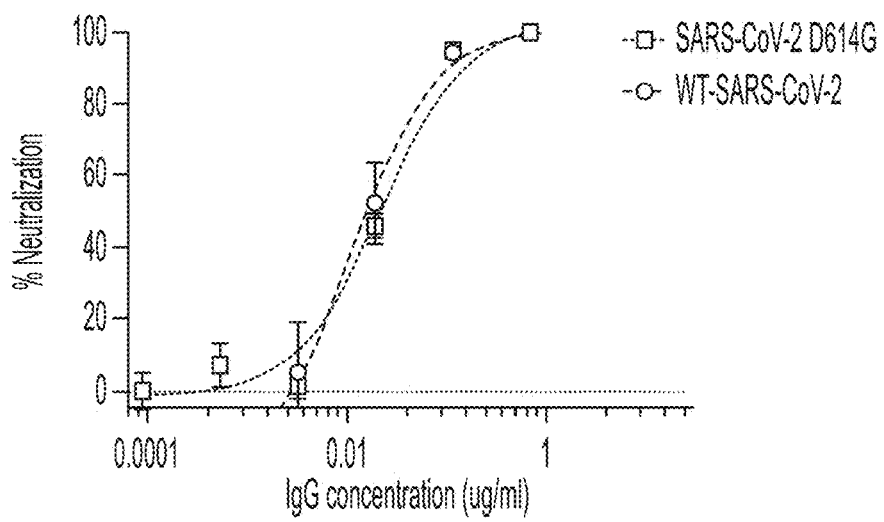
Figure 39G:
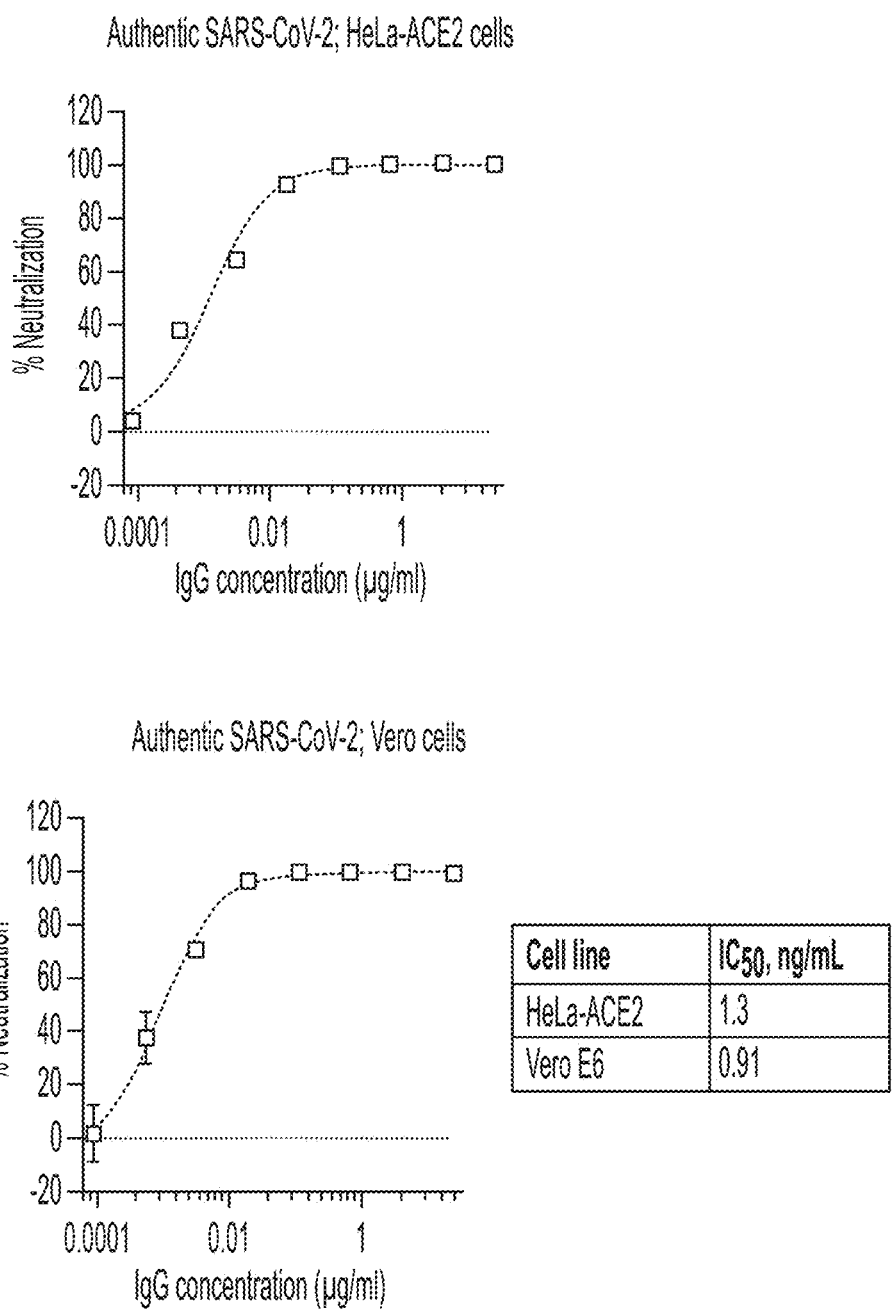
Figure 39H:
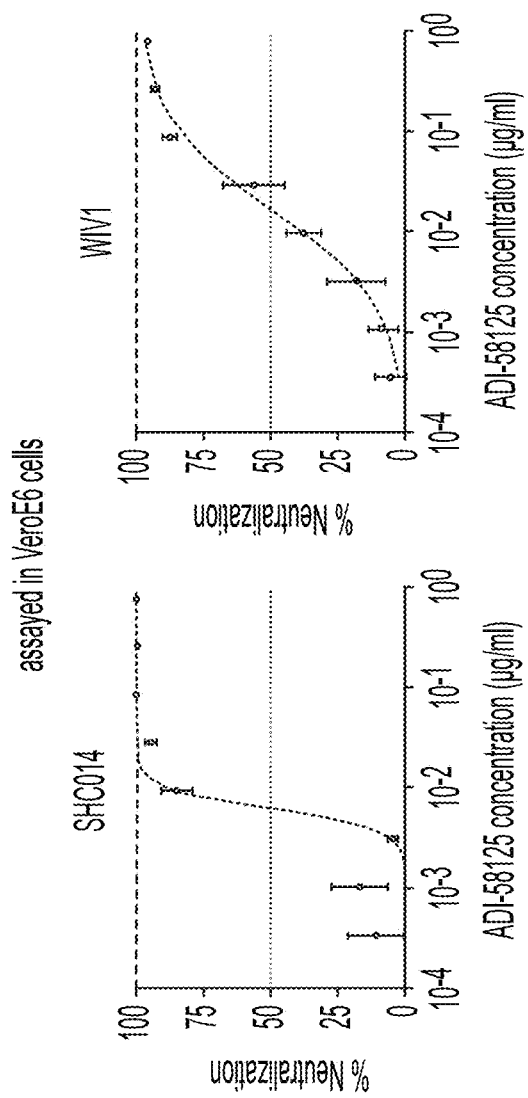
Figures 39K, 39L:
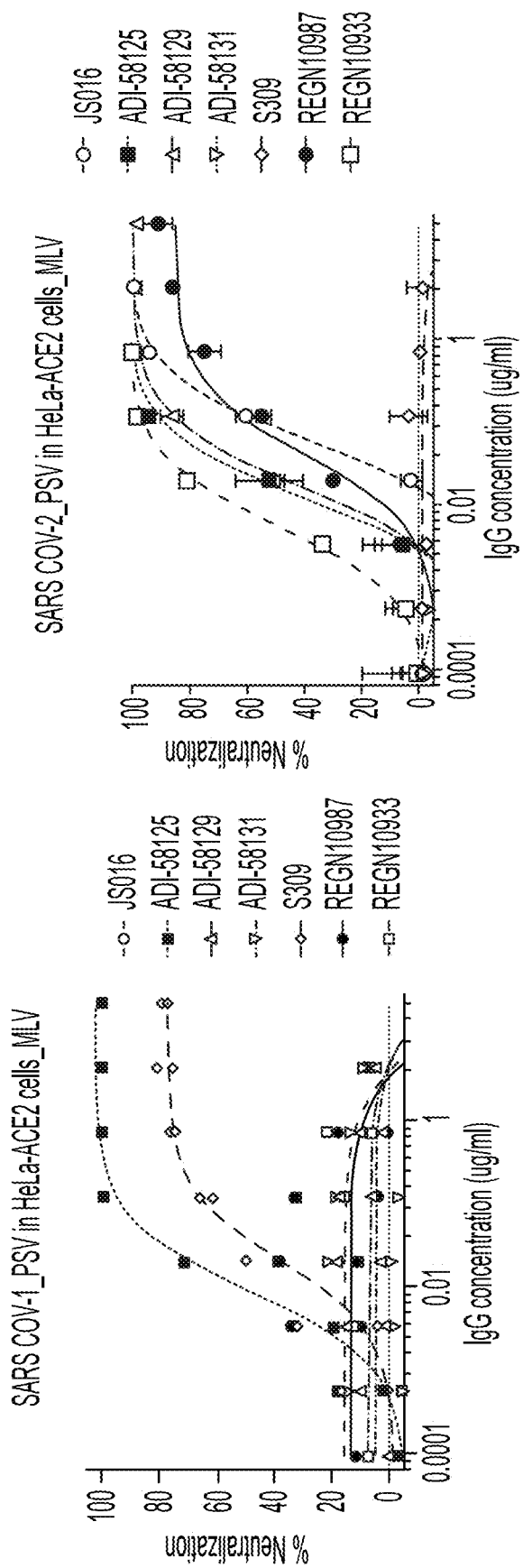
Figure 39M:
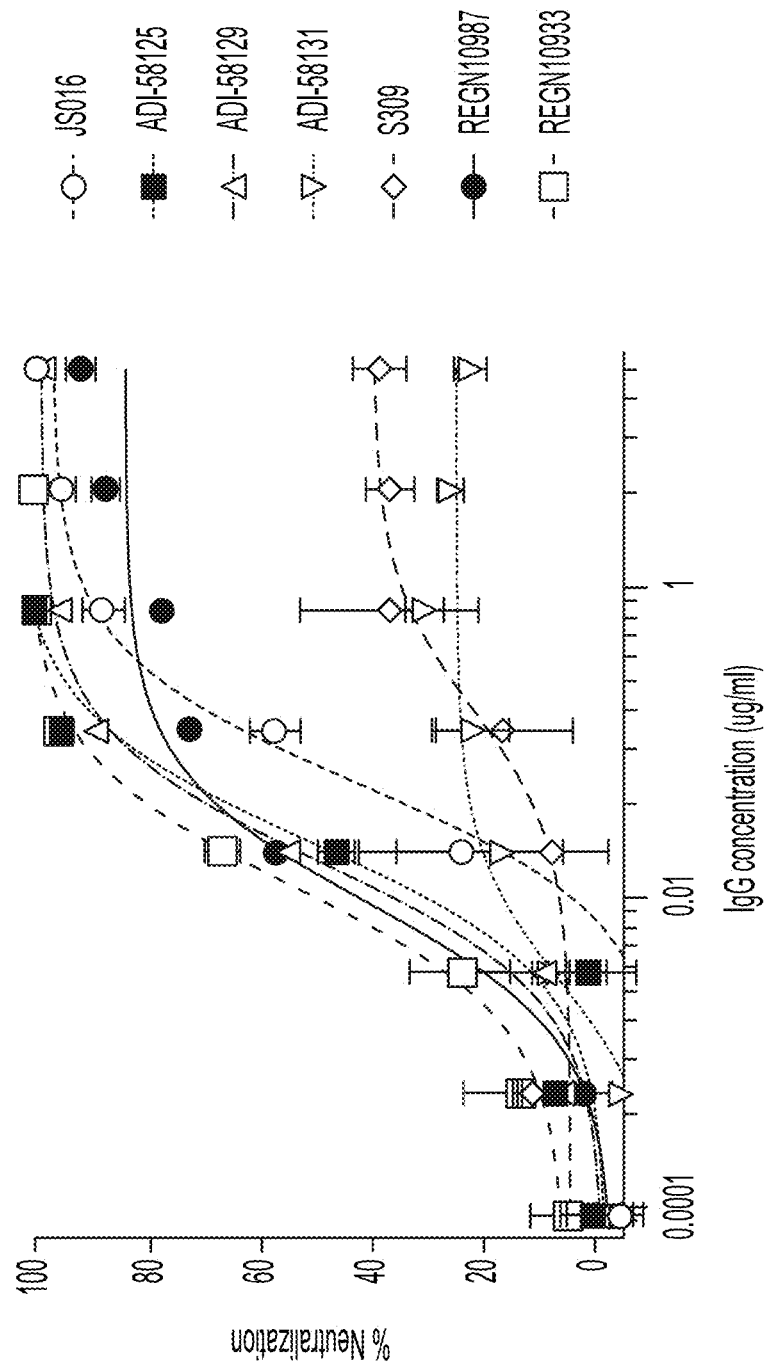
Figures 39N, 39O:
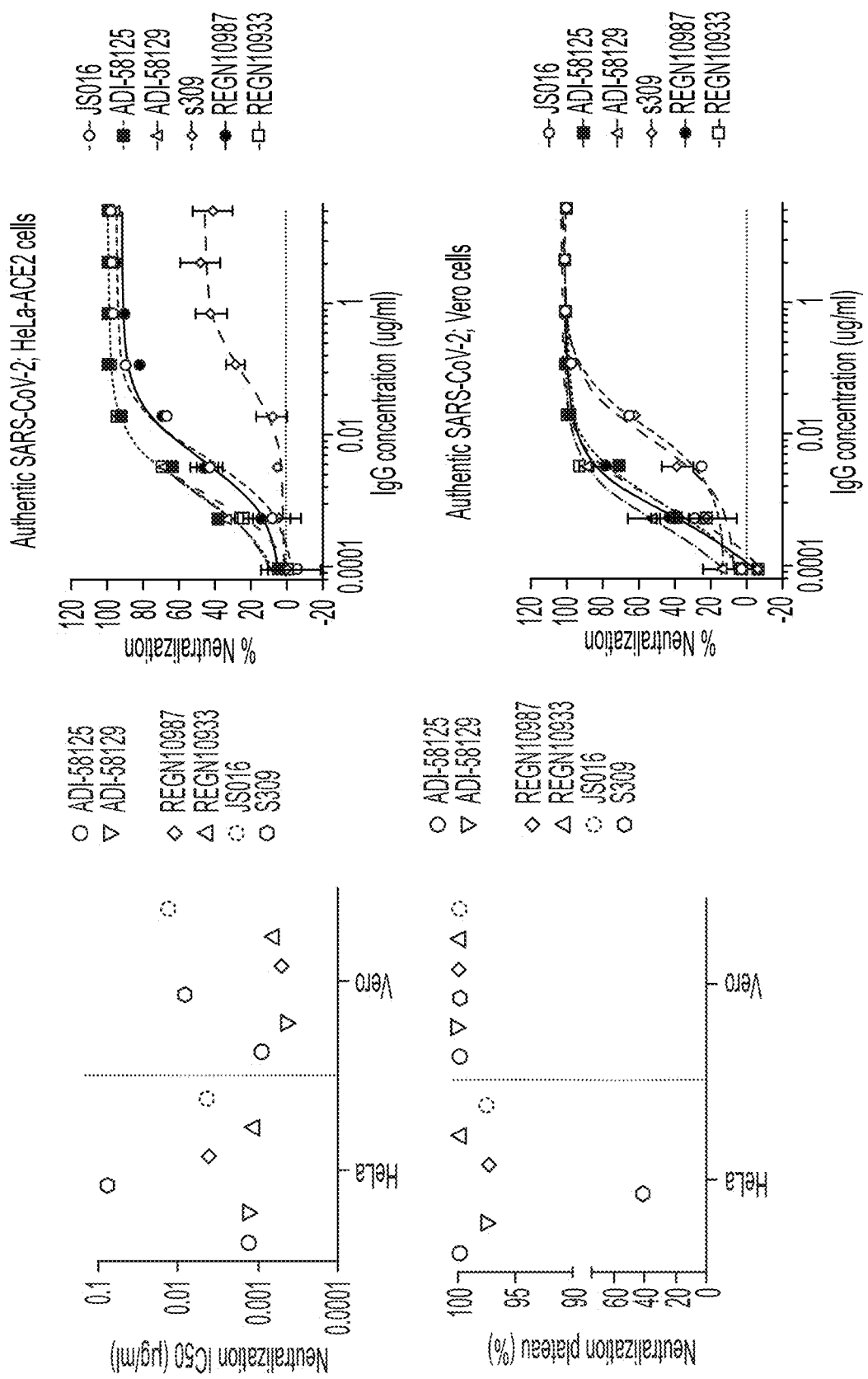
FIG. 39N provides authentic SARS-CoV-2 neutralization titrations with ADI-58125 performed using either HeLa-ACE2 (top) or Vero (bottom) target cells. The curves were fitted by nonlinear regression (log[inhibitor] vs. normalized response, variable slope).
FIG. 39O provides a comparison of IC50 values (top) and neutralization plateau (bottom) for ADI-58125 and ADI-58129, along with clinical antibodies.

Consistent with their broadly neutralizing activities, S309, ADI-58124, and ADI-58126 displayed remarkably broad binding reactivity to clade I sarbecovirus RBDs, with ADI-58124 and ADI-58126 strongly binding 12/13 viruses and S309 binding all 13 (FIG. 40B). In contrast, ADI-58120 bound to 9/13 viruses and CB6/JS016, REGN10987, and REGN10933 bound only the closest evolutionary neighbor(s) of SARS-CoV-2, consistent with their narrow neutralization profiles (FIG. 39B and FIG. 40B). Notably, ADI-58124 bound with high affinity (KDApp 0.24-1.12 nM) to every clade I sarbecovirus RBD that exhibited detectable hACE2 binding in our assay. This finding supports the high degree of ADI-58124 epitope conservation among sarbecoviruses that can utilize hACE2 as a receptor.

Figure 40C:
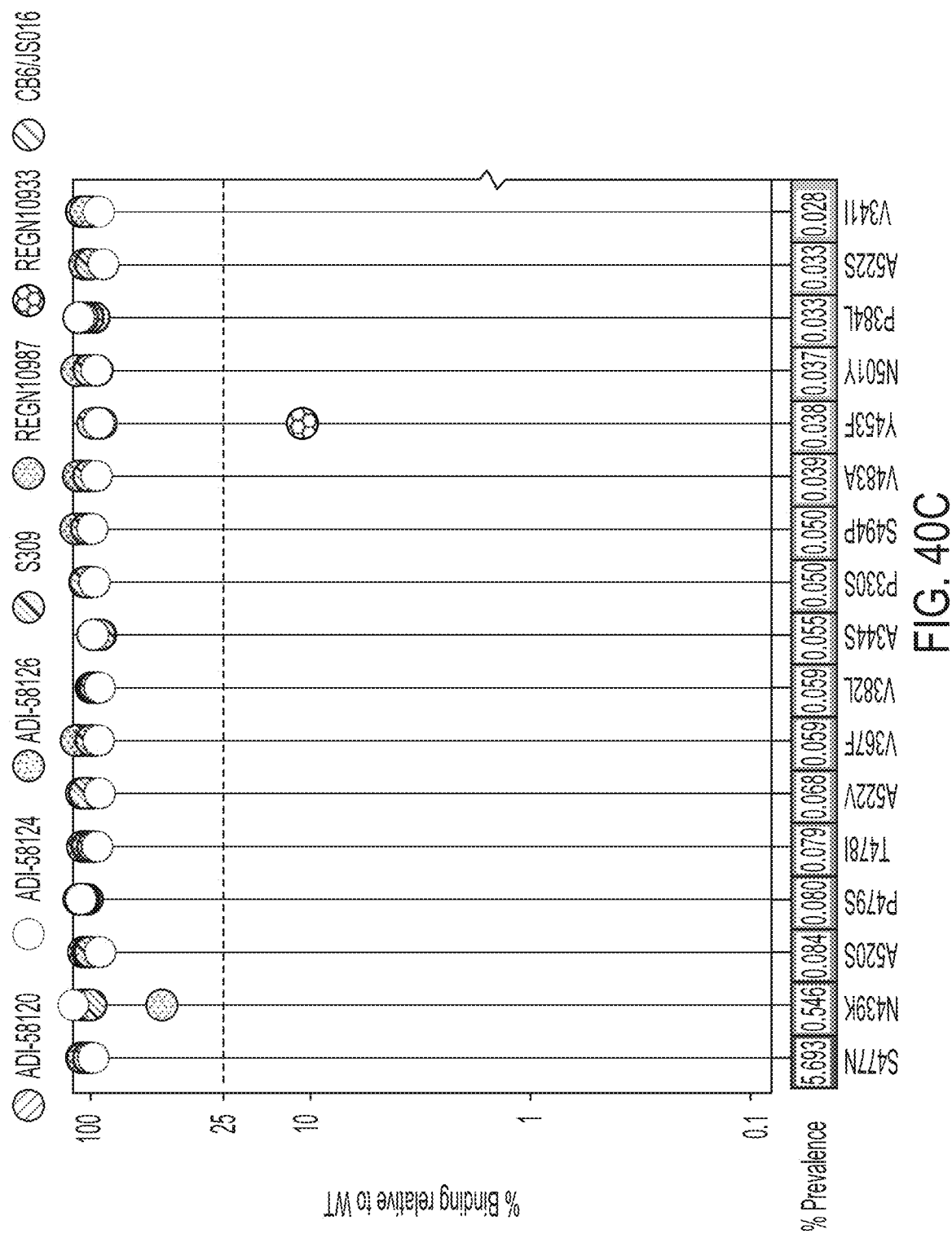

Several recent studies have shown that RBD mutants that are resistant to commonly elicited SARS-CoV-2 nAbs are circulating at low levels in the human population (B. Korber et al., Cell 182, 812-827 (2020); Y. Weisblum et al., bioRxiv, (2020)). The breadth of ADI-58124 binding to naturally circulating SARS-CoV-2 variants that contain single point mutations in the RBD was assessed. ADI-58120, ADI-58126, and the clinical SARS-CoV-2 nAbs were also included as comparators. Using the yeast surface-display platform described above, we expressed the 36 most frequently observed SARS-CoV-2 RBD variants reported in the GISAID database as well as several naturally circulating SARS-CoV-2 variants that have been shown to be resistant to previously described SARS-CoV-2 nAbs (Y. Shu, J. McCauley, Euro Surveill 22, 30494 (2017); B. Korber et al., Cell 182, 812-827 (2020); Y. Weisblum et al., bioRxiv, (2020)). One or more of the 36 SARS-CoV-2 variants displayed resistance (<25% of WT binding) to ADI-58120, CB6/JS016, REGN10987, and REGN10933. Notably, the resistant variants identified for REGN10987 and REGN10933 partially overlapped with those identified in previous in vitro neutralization escape studies, validating the use of our RBD display platform for the prediction of antibody escape mutations (A. Baum et al., Science 369, 1014-1018 (2020)). In contrast, ADI-58124, ADI-58126, and 5309 bound to all 36 variants with affinities ≥50% of WT SARS-CoV-2 (FIG. 40C). This result, combined with the remarkable neutralization breadth observed for these three mAbs (FIG. 39B, FIG. 40B, and FIG. 40D), suggests a potential link between epitope conservation and resistance to viral escape.

Figure 40F:
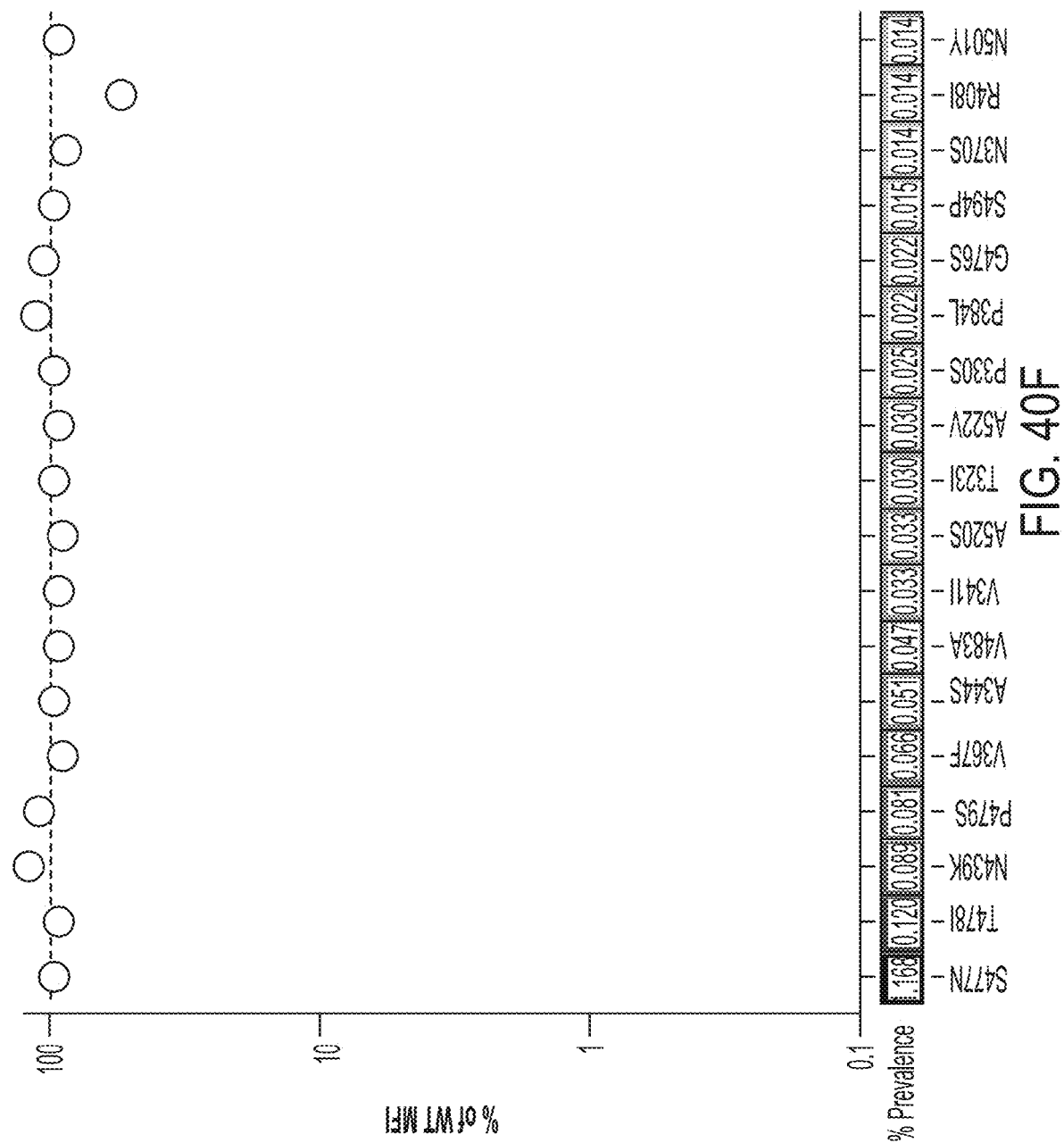

Binding breadth for ADI-58125 was determined in the same manner and the results are provided in FIGS. 40E-40F.

Unlike other clinical antibodies, ADI-58125 binds to residues that are not targeted by the endogenous antibody response. Indeed, other clinical antibodies bind around residues that are subject to frequent mutations, such as residues 439, 453, 417, 484, 494, 490, 444, 446, or 484 which were shown to have a frequency of mutations at site of about $10^{0.2}$ to $10^4$, and some of the most frequent mutations also fall within these regions, for example, N439K (with a cumulative prevalence of 1.49%), and Y453F (with a cumulative prevalence of 0.365%) (Greaney et al., Comprehensive mapping of mutations of the SARS-CoV-2 receptor-binding domain that affect recognition by polyclonal human serum antibodies, BioRxiv, 2020). For example, other "class 1" antibodies such as C105, CC12.1, CC12.3, COVA2-4, B38, Ly-Cov16, and REGN10933 bind to residues around Q493R, Y453F, F486V, and K417N. Other "class 2" antibodies such as C104, P2B-2F6, BD23, Ab2-4, 5A6 and Ly-CoV555 bind to residues around E484K, F490L, and S494P. Other "class 3" antibodies such as C135 and REGN10987 bind around N440K, K444N, V445E, N439S, and G446V. Finally, other "class 4" antibodies such as CR3022 and EY6A bind to different regions/residues. However, all these regions with a high frequency of mutations occurred outside the binding epitope for ADI-58125. Other mutations include S477N (with a cumulative presence of 5.69%, N501Y (with a cumulative presence of 1.39%), E484K, K417N, S494P, L452R, G446V, F490S, L452M, L455F, E484Q, F486L and G485R (Greaney et al., BioRxiv, 2020).

Figure 40G:
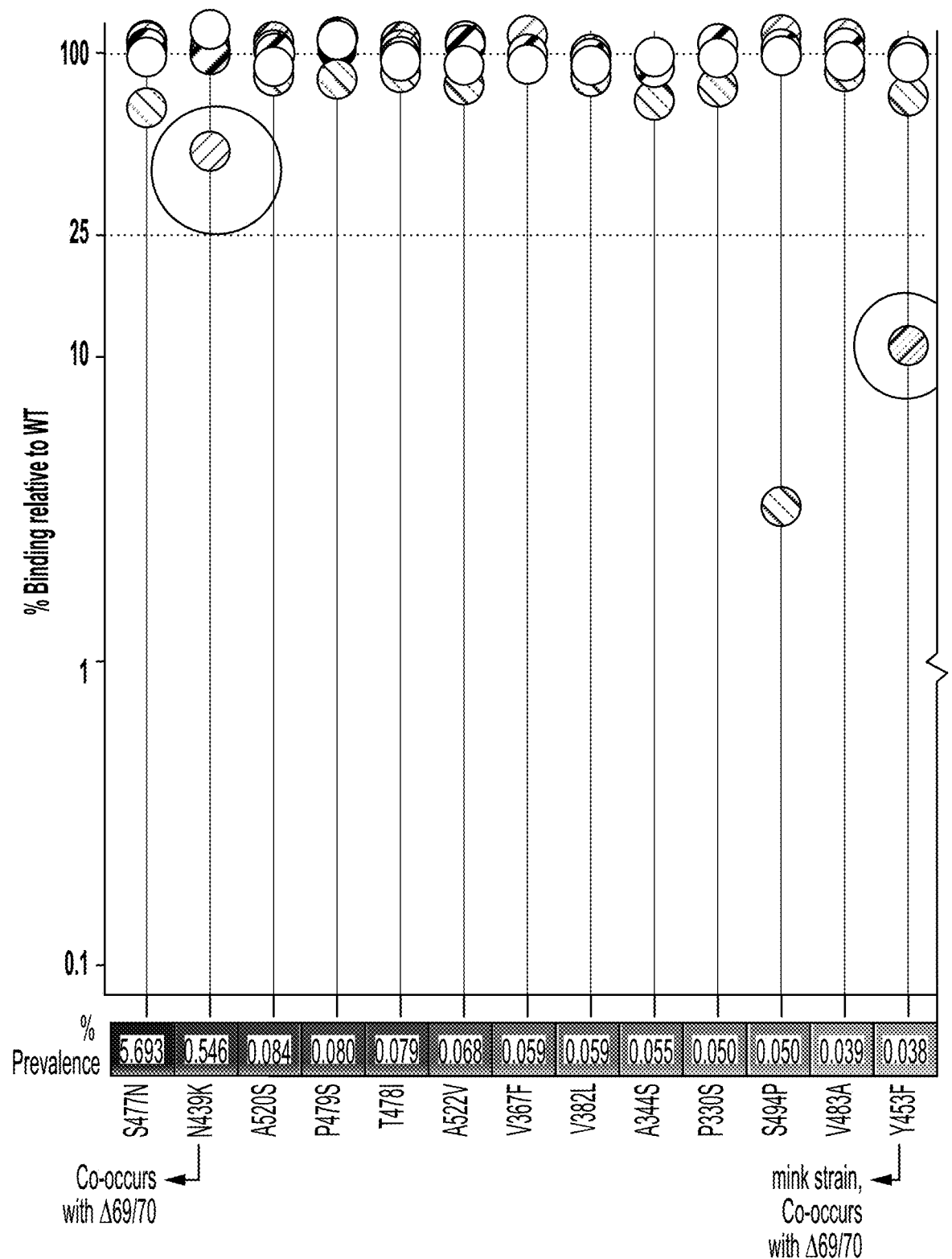
Figure 40G:
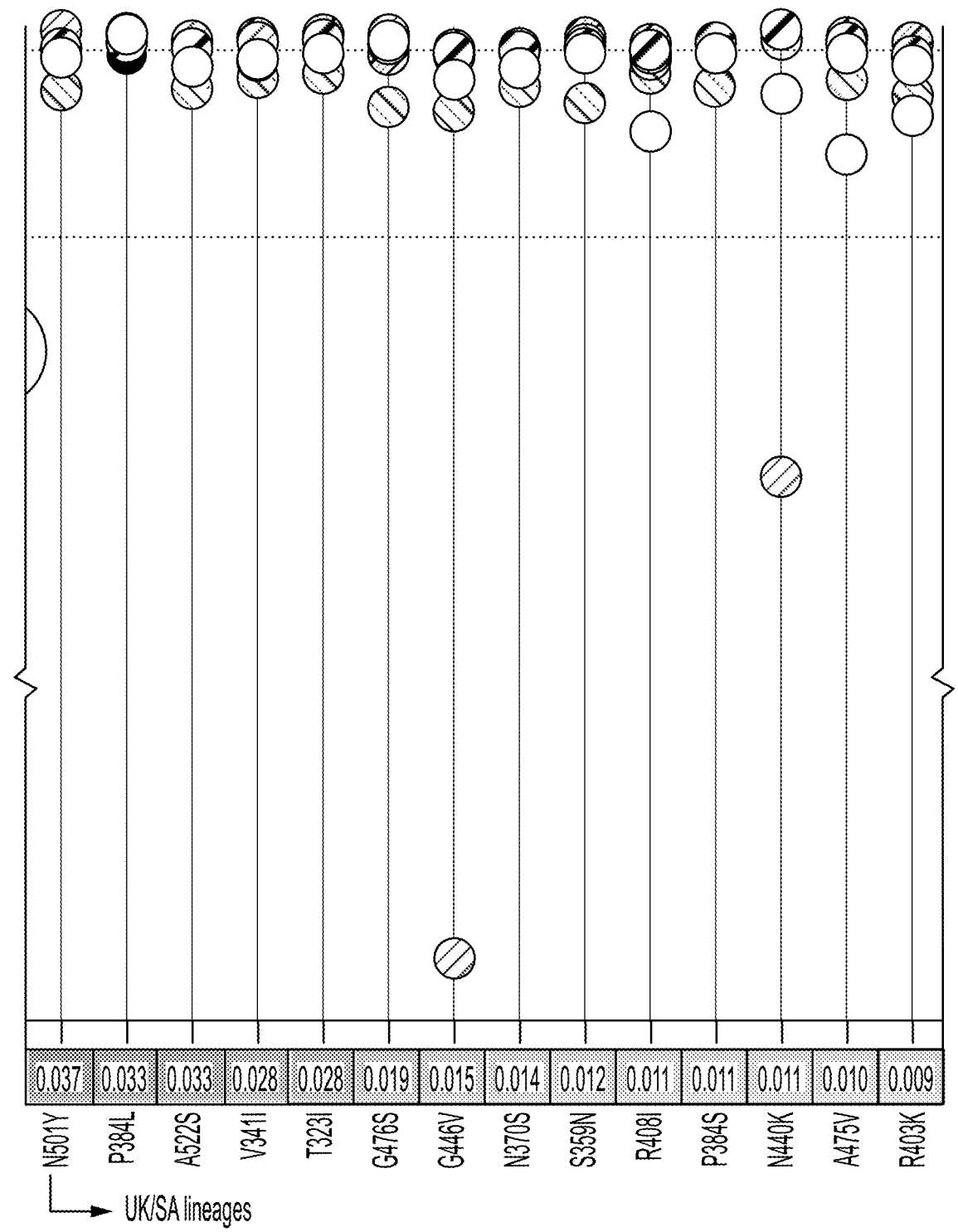
Figure 40G:
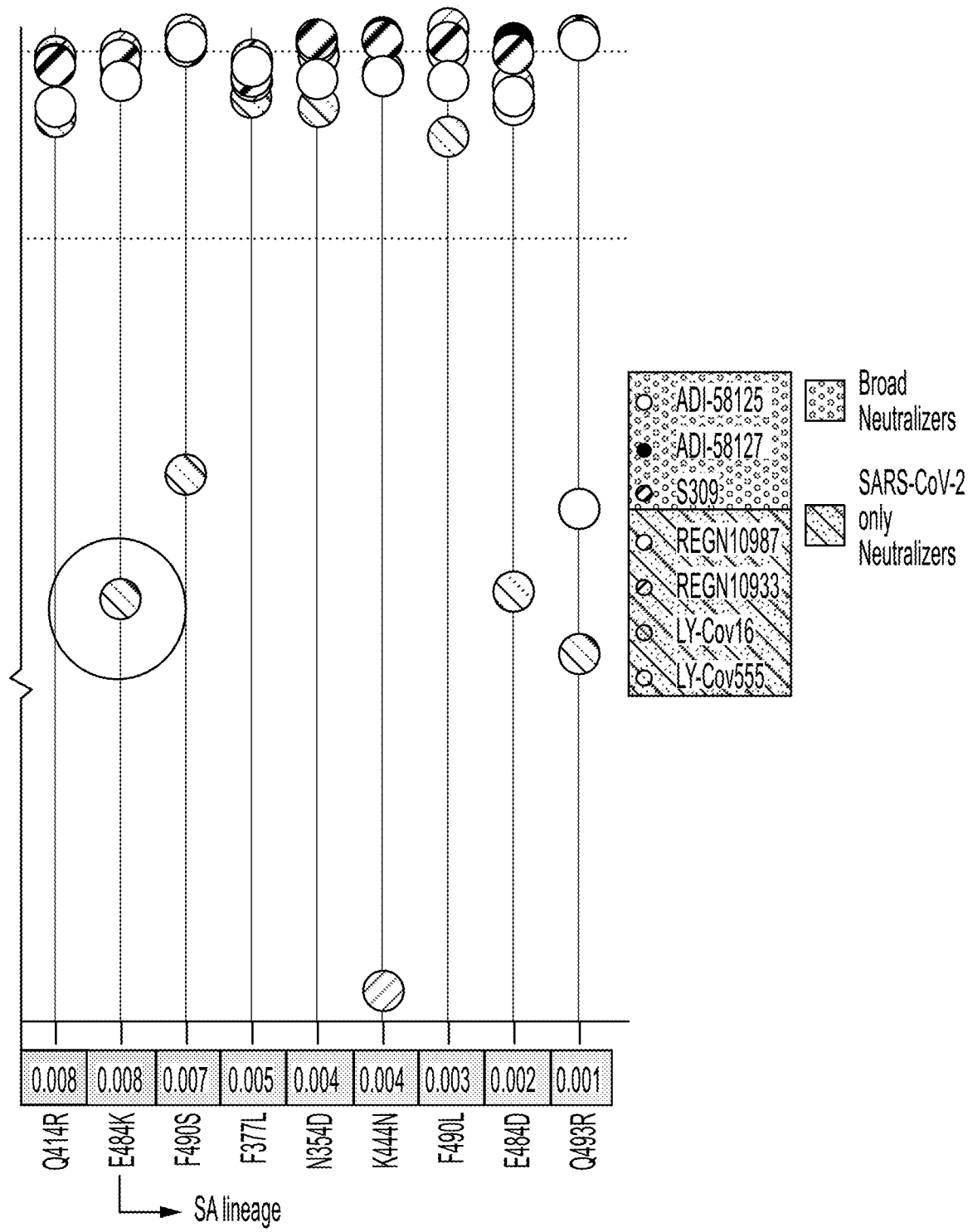
Figure 40H:
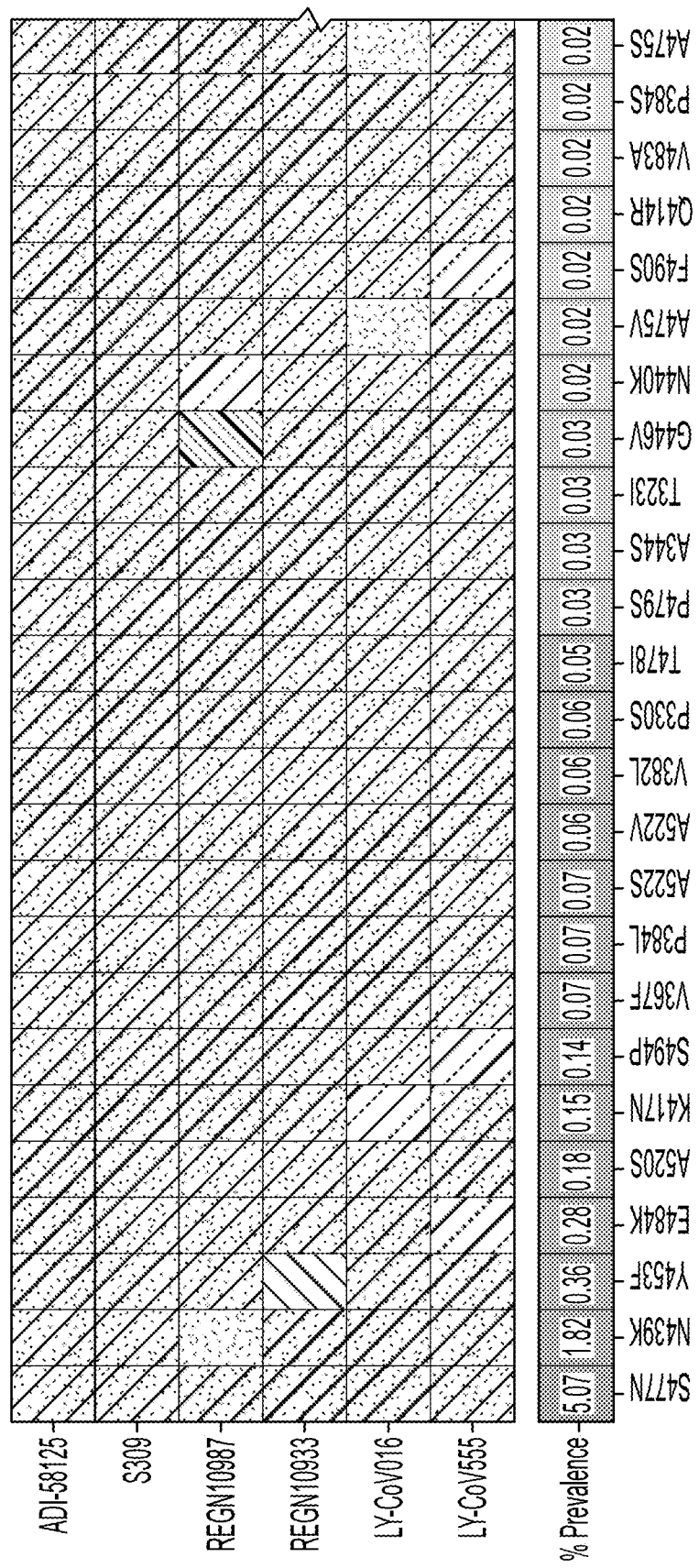
Figure 40H:
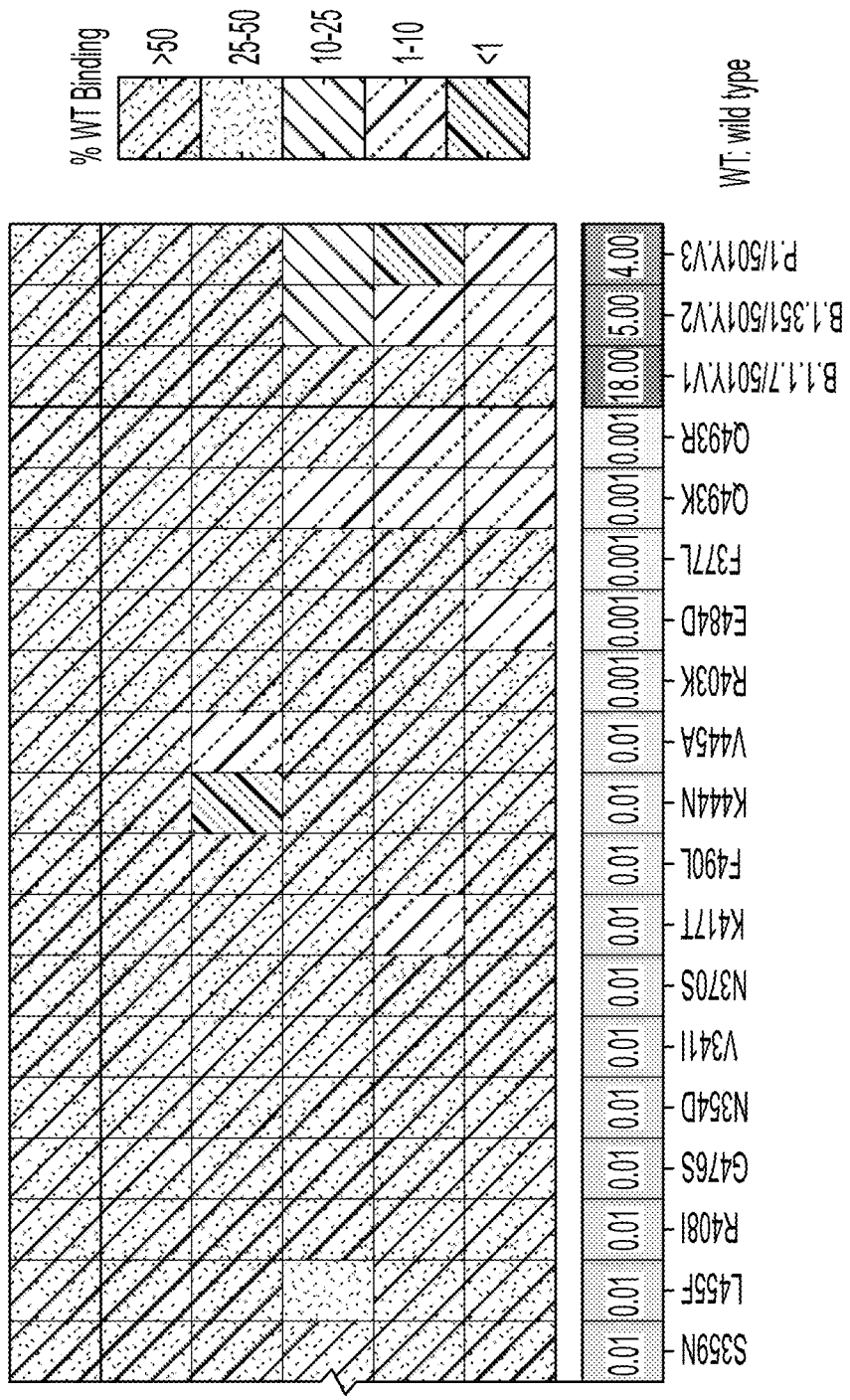

Furthermore, ADI-58125 was able to bind to all common circulating SARS-CoV-2 variants described to date, such as the UK lineage, the South Africa lineage, the newly emerged B.1.1.7 lineage and/or the mink strain (FIG. 40G). The B.1.1.7 variant carries a large number of mutations, suggesting that it may have arisen in a chronically infected patient (Kemp et al., Recurrent emergence and transmission of a SARS-COV-2 spike deletion H69/H70, BioRxiv, 2020; Gupta et al., Biorxiv, 2020; the entire contents of each of which are expressly incorporated herein by reference). Several of the mutations in this variant are in the S protein including a deletion at positions 69 and 70 that evolved spontaneously in other SARS-CoV-2 variants and is hypothesized to increase transmissibility (KempSA et al., BioRxiv 2021). This disproportionate number of mutations in the S protein strongly suggests immune escape. The NTD deletion often co-occurs with RBD mutations N501Y, Y453F, N439K, and E484K and K417N.

Figure 40I:
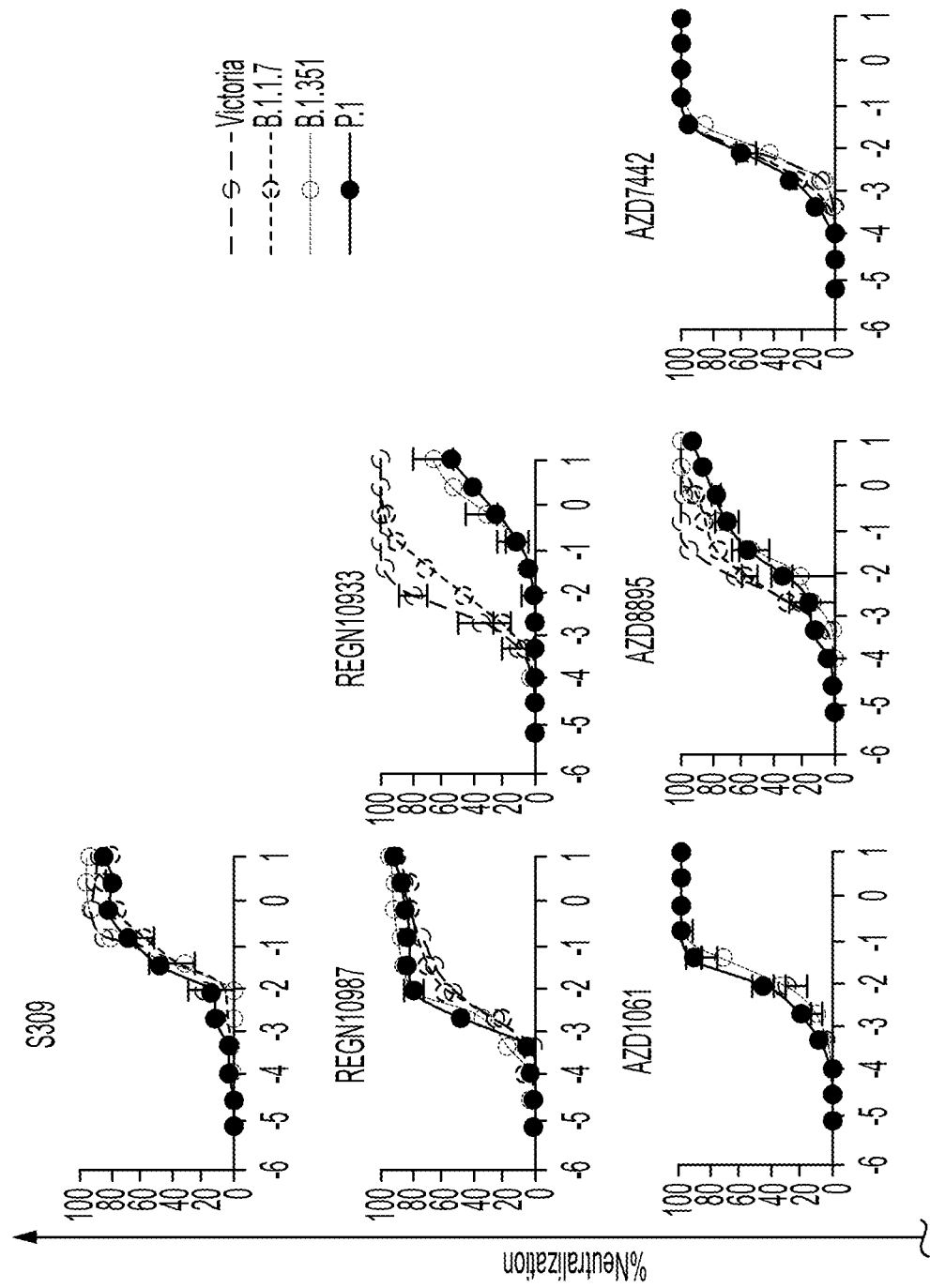
Figure 40I:
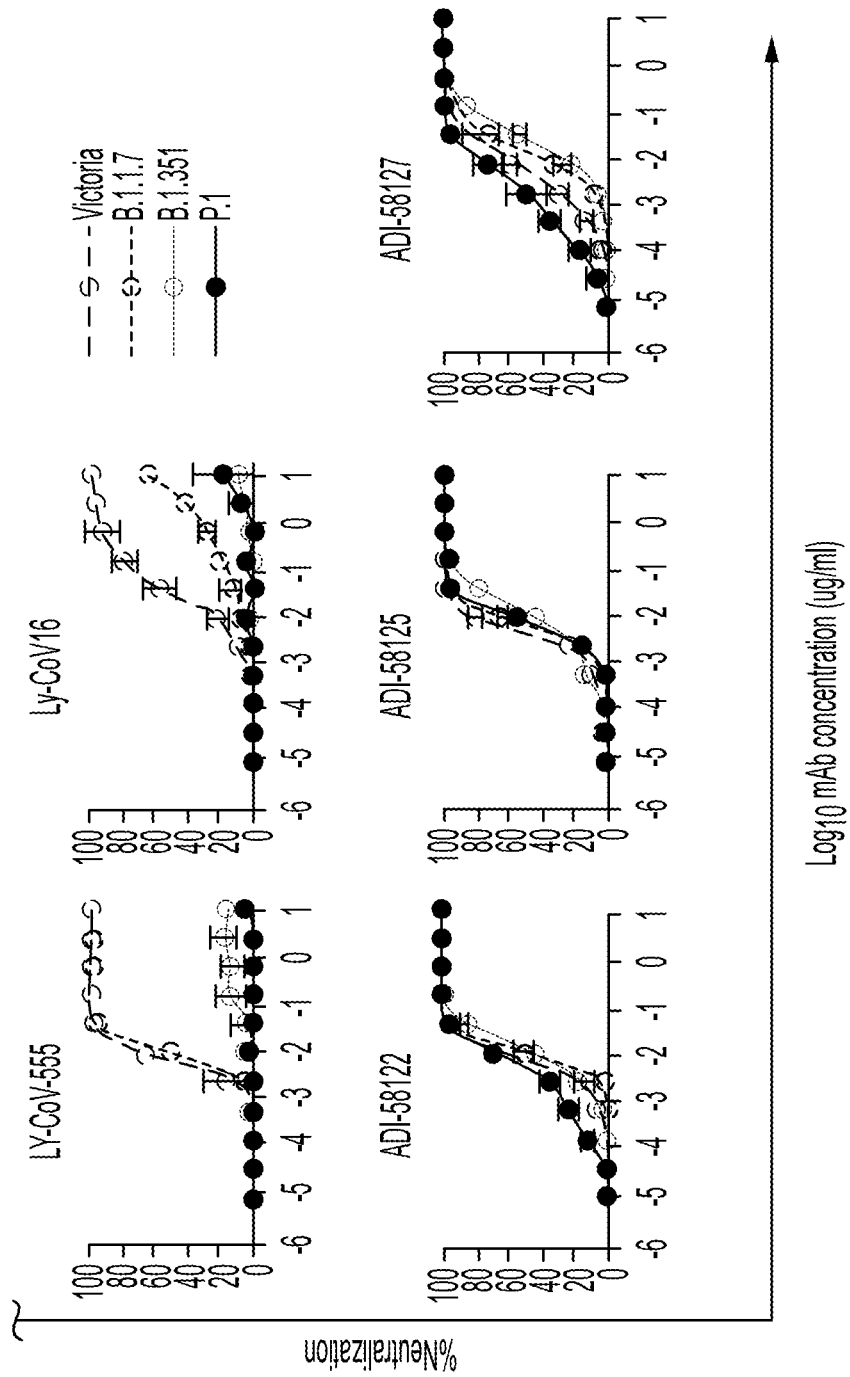

ADI-58125 was able to bind with high affinity to 12 of 13 clade 1 sarbecoviruses, including all RBDs exhibiting detectable human ACE2 binding. RBDs harbouring mutations present in the B.1.351 and P.1 variants, which are associated with increased resistance to neutralisation by convalescent and vaccinee sera, bound with reduced affinity to several clinical antibodies (FIG. 40I1). In contrast, ADI-58125 retained high affinity binding to all common SARS-CoV-2 variants as well as to the B.1.1.7, B.1.351 and P.1 variants (FIG. 40I). Similarly, ADI-58122 and ADI-58127 also retained high affinity binding to P.1 strain. Indeed, although the variants can escape neutralization by a number of monoclonal antibodies, these three antibodies (ADI-58122, ADI-58125 and ADI-58127) showed little to no reduction in neutralization activity against the variants, and also neutralized P.1 variant with all reaching a plateau at 100% neutralization, whereas REGN10987 and 5309 failed to reach 100% neutralization (FIG. 40I and FIG. 50C). Authentic B.1.1.7 and B.1.351 variants remained fully susceptible to ADI-58125 neutralisation (data not shown).

ADI-58125 displays exceptional breadth of binding to RBDs from clade 1 sarbecoviruses and variants of SARS-CoV-2 resistant to other antibody therapies. No loss of binding affinity for the B.1.1.7, B.1.351 and P.1 variants was observed, and ADI-58125 neutralisation potency was maintained against the B.1.1.7 and B.1.351 variants. The unique, broadly neutralising activity of ADI-58125 highlights its potential to be an effective prophylactic and therapeutic agent against emergent variants of SARS-CoV-2 resistant to other clinical stage mAbs as well as pre-emergent SARS-like viruses with pandemic potential.

ACE2 Inhibition of S by ELISA

Figure 40J:
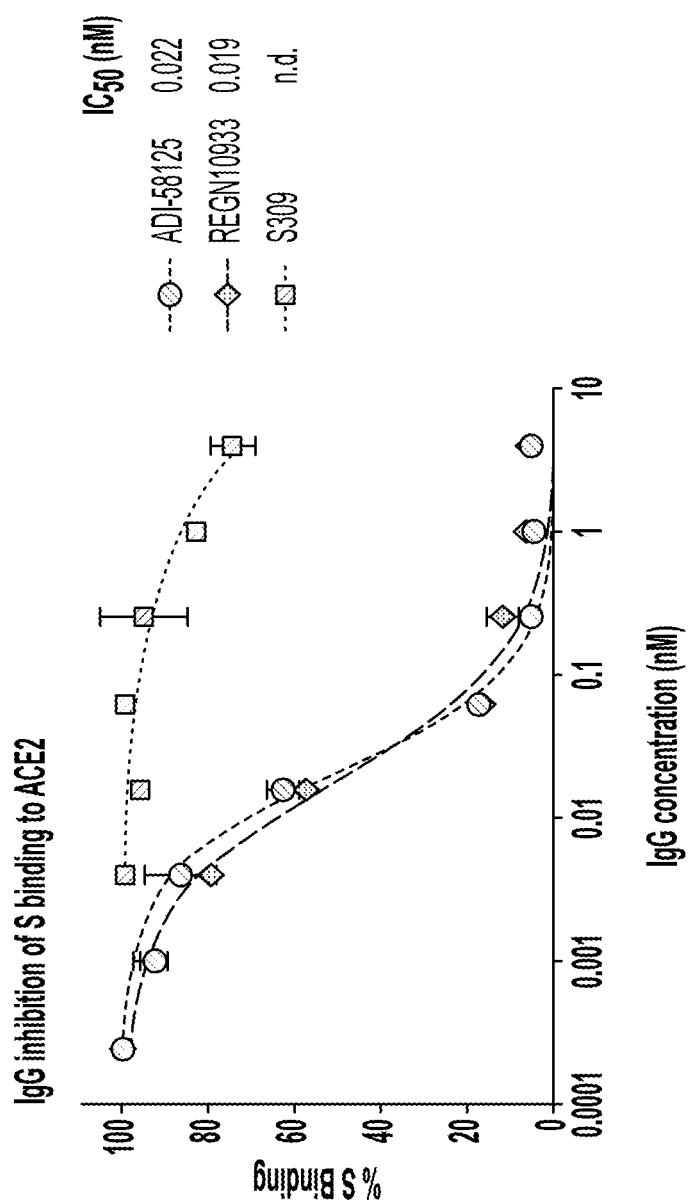

The median inhibitory concentration (IC50) of ADI-58125 required to block binding of spike protein to ACE2 was measured in a competition ELISA assay. ADI-58125 potently blocked ACE2 binding with a sub-nanomolar $IC_{50}$ of 0.022 mM (3.3 ng/ml) (FIG. 40J). REGN10933, a known ACE2 competitor, blocked S binding, while 5309, a known non-competitor, showed minimal inhibition of S binding, thus validating the use of this assay. ADI-58125's strong blocking activity is consistent with its high binding affinity and supports ACE2 blocking as a primary mechanism of its potentneutralization against SARS-CoV-2.

Brief description of methods used is provided below.

Figure 41A:
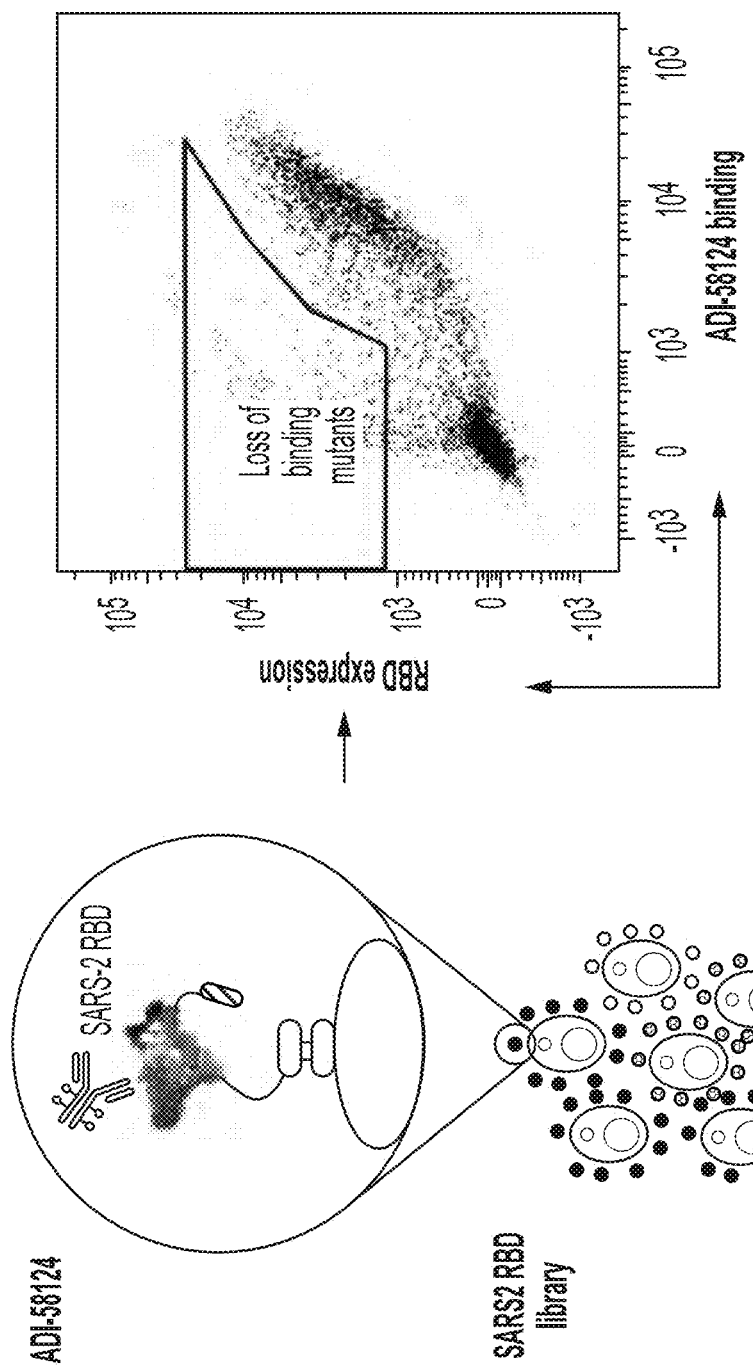
Figure 41B:
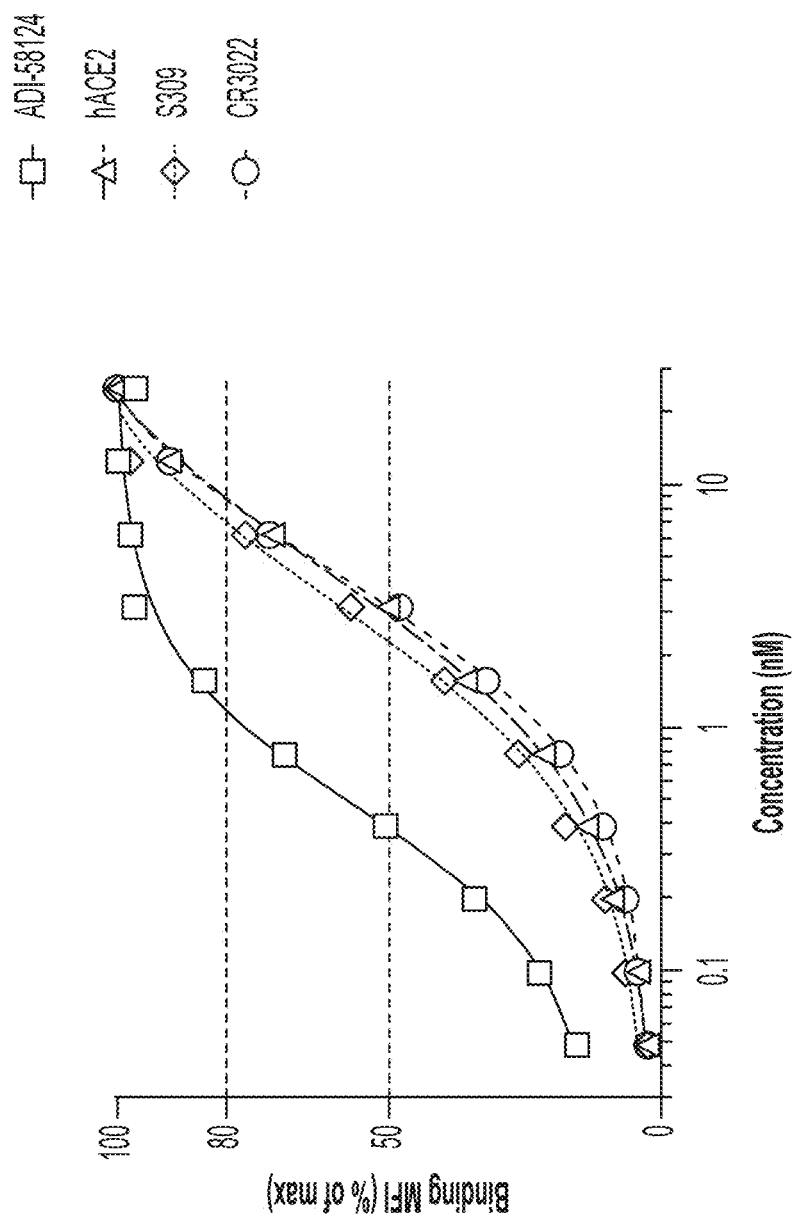
Figure 41C:
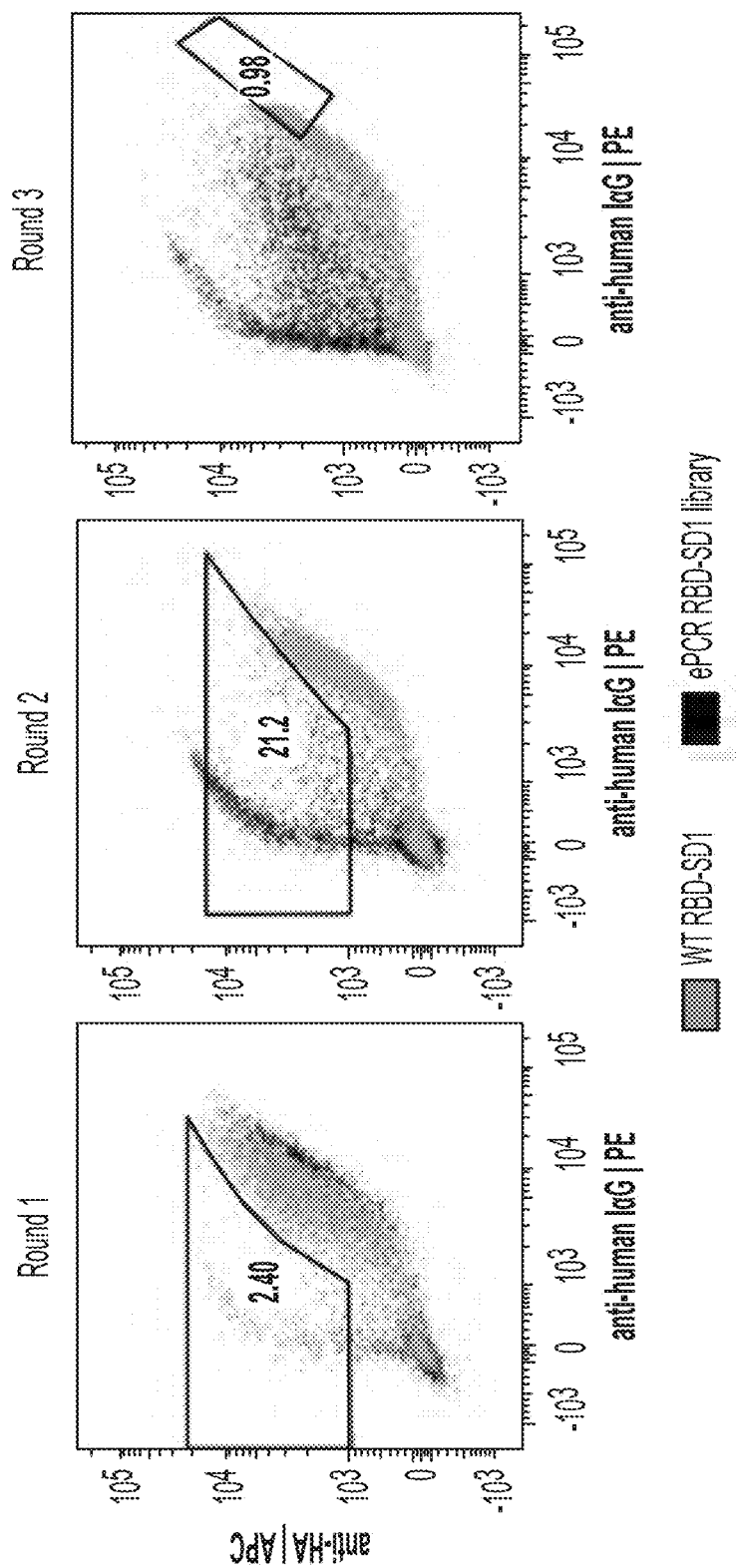
Figure 41D:
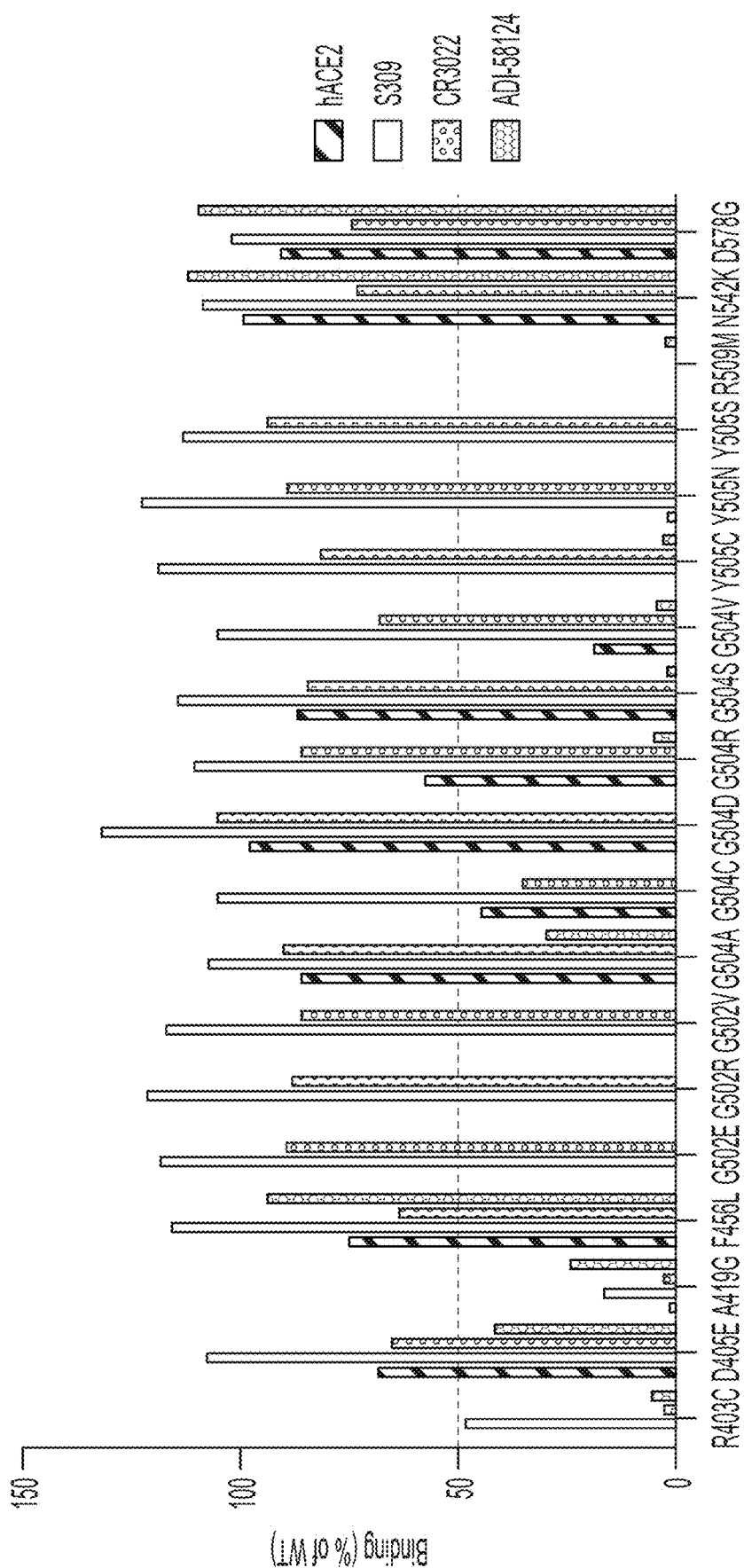
Figure 41E:
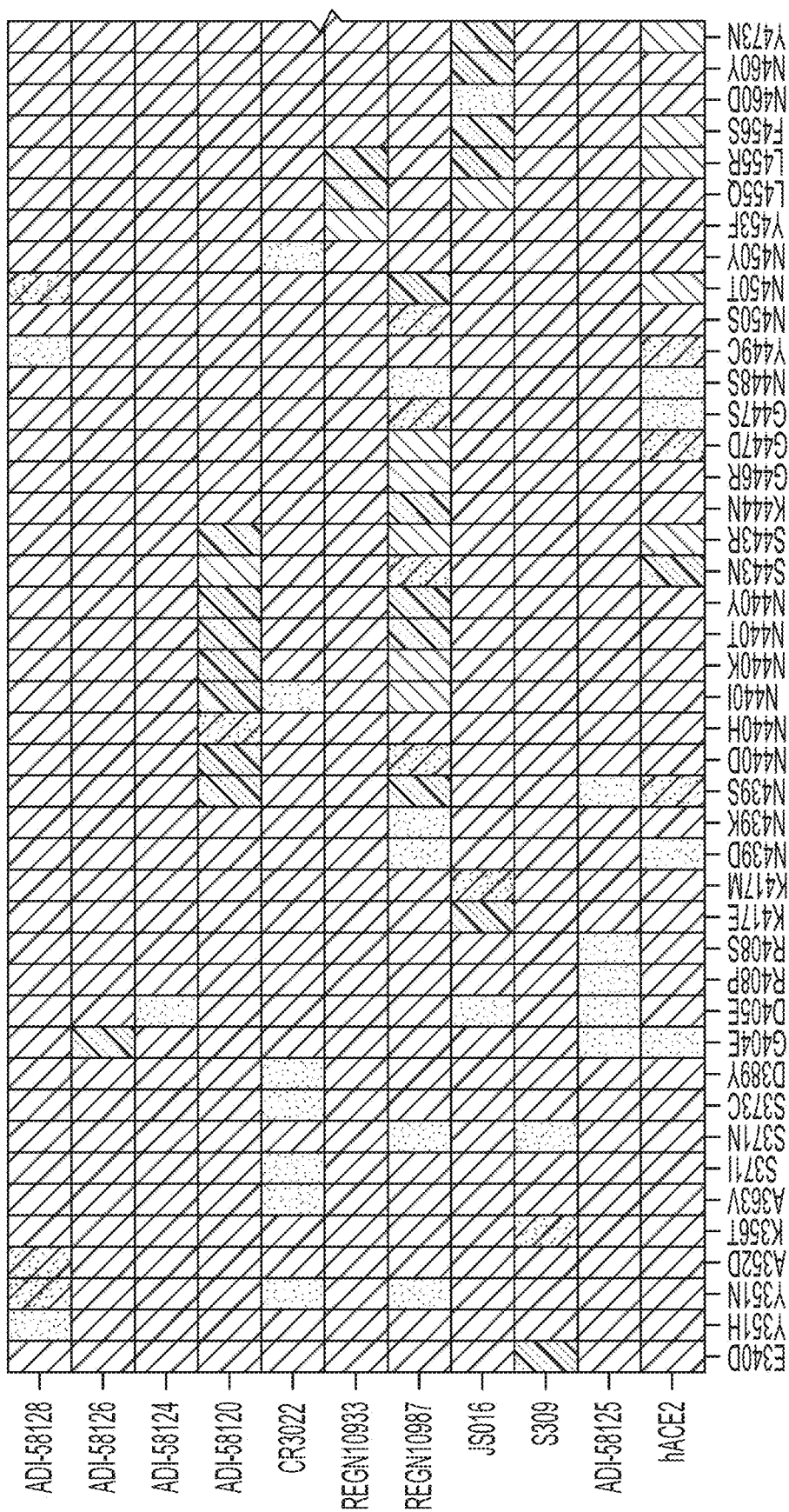
Figure 41E:
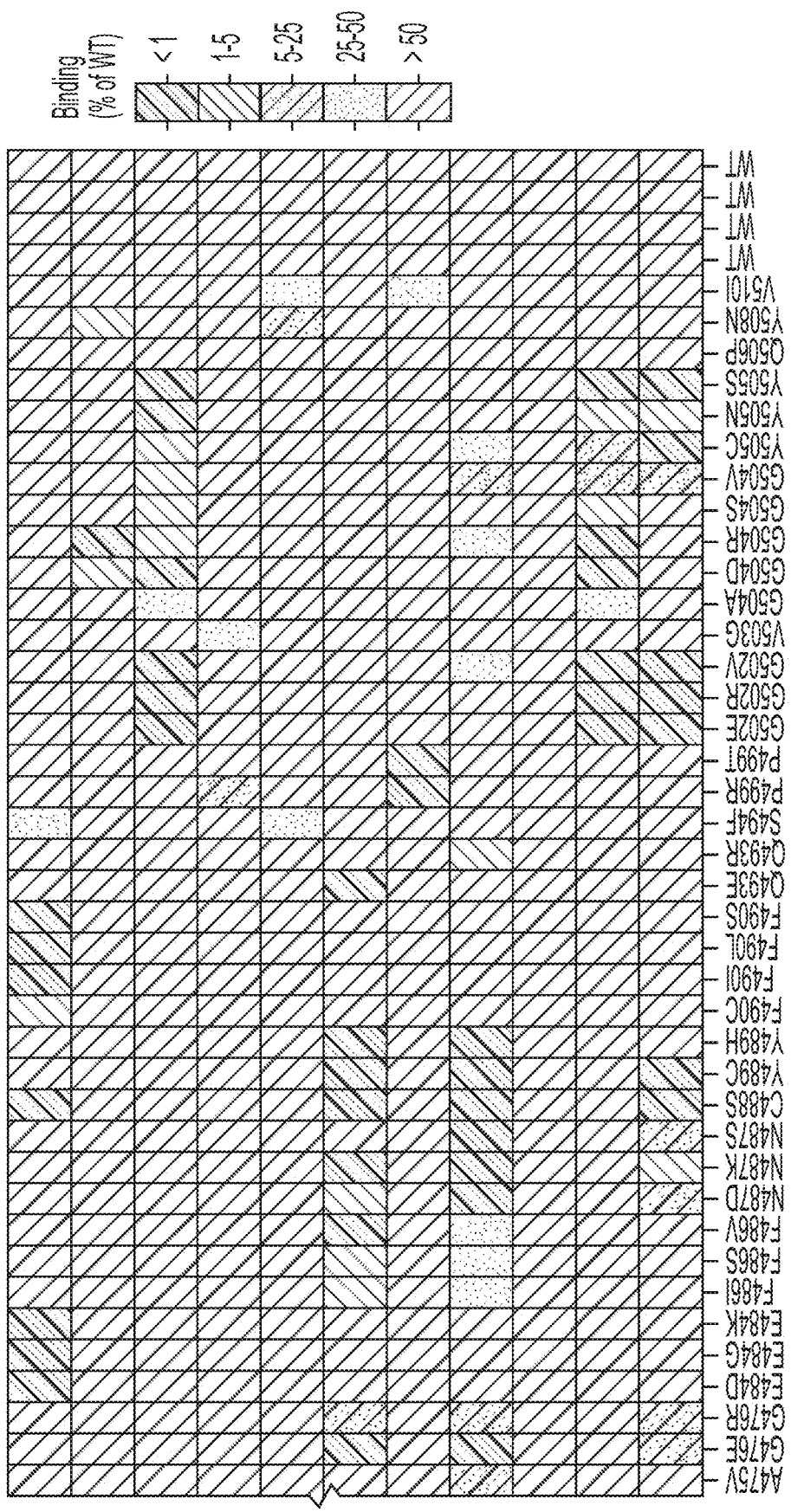
Figure 41G:
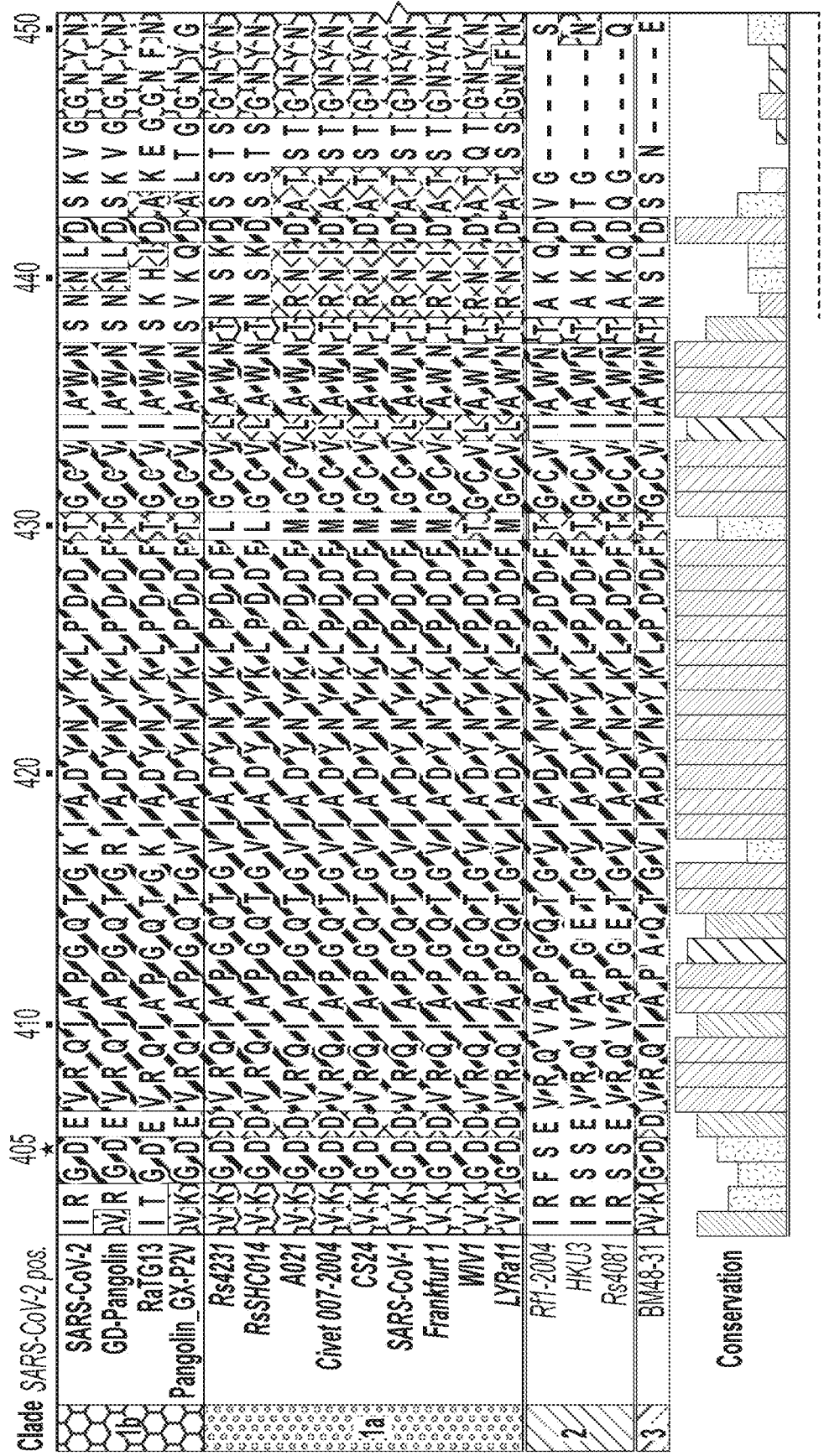
Figure 41G:
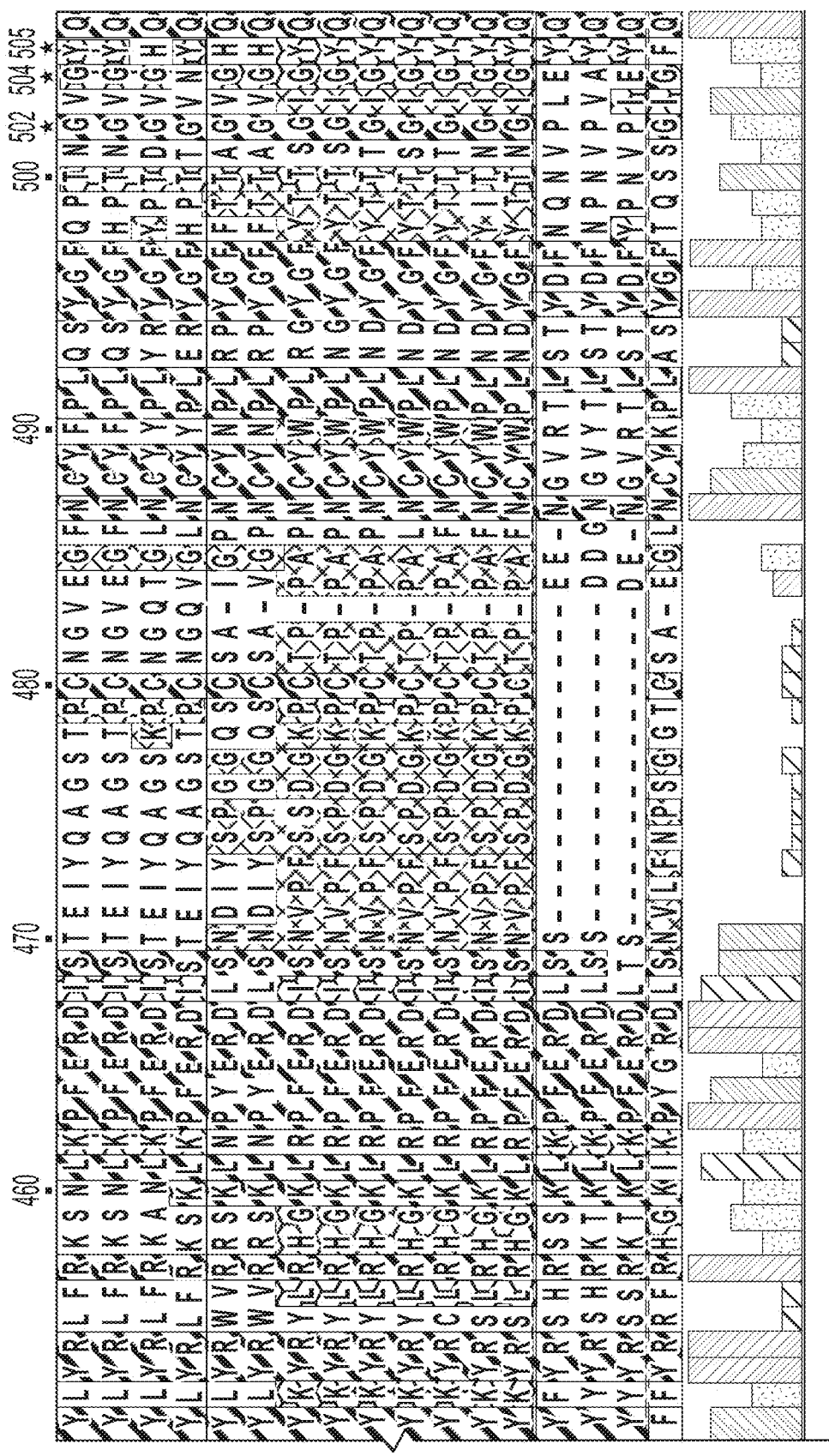
Figures 41H, 41I, 41J:
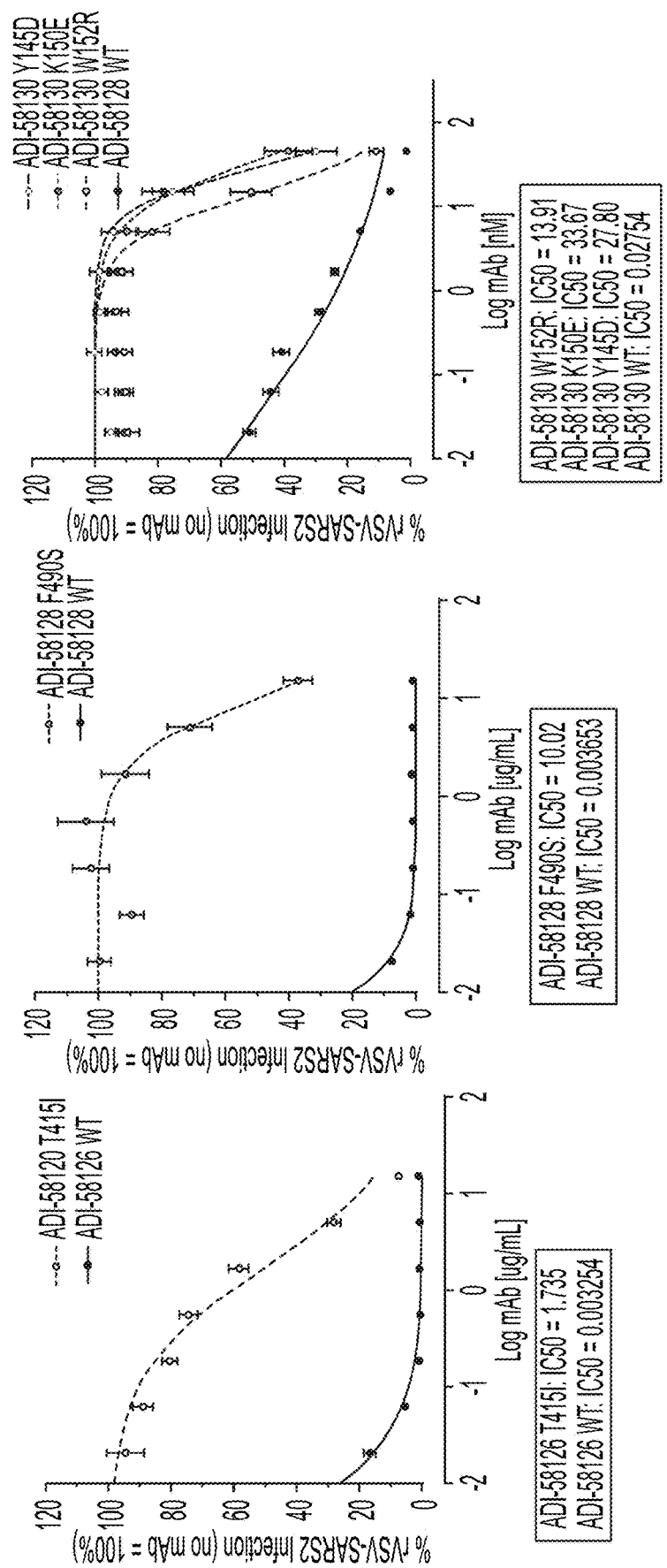
FIGS. 41H-41J provide results from the escape mutant analyses in Example 27. The ability of ADI-58120 (FIG. 41H (left)), ADI-58124 (FIG. 41H (right)), ADI-58126 (FIG. 41I (left)), ADI-58128 (FIG. 41I (right)), and ADI-58130 (FIG. 41J) to inhibit infection of Vero cells by rVSV comprising indicated SARS-CoV-2 S protein mutants was tested. Increased IC50 indicates that the indicated mutation in the S protein conferred resistance.

Sarbecovirus Phylogeny and Alignment:

Representative sarbecovirus RBD-SD1 sequences were selected based on sequence sets curated by Letko et al. and Starr et al. (Letko M. et al., *Nat Microbiol* 5, 562-569 (2020); T. N. Starr et al., *Cell* 182, 1295-1310 (2020)). Four other ACE2-utilizing sarbecoviruses (Frankfurt 1, CS24, Civet 007-2004, and A021) not studied in previously curated sets were added here as each possessed unique sequences at the RBD-ACE2 interface, thus spanning additional sequence distance across the clade I phylogeny. A limited set of clade 2 and clade 3 members, which are known to use alternative receptors to ACE2, were included as controls (Letko M. et al., *Nat Microbiol* 5, 562-569 (2020)). A phylogram of sarbecoviruses was generated using maximum likelihood analysis of mafft-aligned RBD-SD1 sequences (FIG. 40A). Multiple sequence alignment of sarbecovirus RBD sequences was visualized in Jalview (FIG. 41J). Amino acid sequences for each sarbecovirus was colored by percentage sequence identity and overall degree of conservation per residue was calculated as a numerical index weighted by physio-chemical properties of amino acids (Livingstone C. D. et al., *Comput Appl Biosci.* 1993 December; 9(6):745-56).

GISAID Analysis of Circulating SARS-CoV-2 Variants:

Genome sequences were downloaded from the GISAID database and pairwise aligned against the reference Wuhan-Hu-1 sequence (ENA QHD43416.1) via an internal implementation of the Needleman-Wunsch algorithm to extract all RBD-SD1 sequences using amino acid residues 319 to 591 of the Wuhan-Hu-1 spike sequence. Incomplete RBD-SD1 nucleotide sequences and those containing ambiguous ("n") base calls, plus translated sequences including "X", "*", or "-," were excluded from analysis. RBD-SD1 sequence variants observed at least 6 times out of 63551 sequences analyzed as of Jul. 14, 2020, as well as several literature controls and antibody escape mutants also observed in the GISAID database, were compiled as a panel 36 variants to assess antibody binding.

As the number of sequences in the GISAID database has been consistently growing since the start of the COVID-19 pandemic, sequences from the GISAID database were pulled again on Oct. 19, 2020 to calculate the "percent prevalence" of each variant. "Percent prevalence" was calculated by dividing the number of appearances of the variant by the total number of complete sequences in the database.

SARS-CoV-2 Variants and Homologous Sarbecovirus RBD-SD1 Cloning:

The spike RBD-SD1 of SARS-CoV-2 (residues 319 to 591 as defined by Uniprot: P0DTC2) and additional related sarbecoviruses (HKU3, ENA AAY88866.1; Rf1-2004, ENA ABD75323.1; BM48-31, ENA ADK66841; Pangolin_GX-P2V GISAID MT072864.1; RaTG13, ENA QHR63300.2; SARS-CoV-2, ENA QHD43416.1; GD-Pangolin, ENA MT121216.1; Rs4231, ENA ATO98157.1; WIV1, ENA AGZ48831.1; Civet 007-2004, ENA AAU04646.1; A021, ENA AAV97986.1; Frankfurt 1, ENA BAE93401.1; SARS-CoV-1, ENA AAP13441; CS24, ENA ABF68959; LYRa11, ENA AHX37558.1; Rs4081, ENA KY417143.1) were ordered as gBlocks (IDT) and cloned into a yeast display expression vector encoding a flexible Gly4Ser linker (SEQ ID NO: 23194) and hemagglutinin (HA) tag at the N-terminus. Two consecutive Gly4Ser linkers (SEQ ID NO: 23195) connect RBD-SD1 to Aga2p at the C-terminus. 36 circulating SARS-CoV-2 variant sequences observed in the GISAID database (T323I, P330S, V341I, A344S, N354D, S359N, V367F, N370S, F377L, V382L, P384L, P384S, R403K, R4081, Q414R, N439K, N440K, K444N, G446V, Y453F, A475V, G476S, 5477N, T478I, P479S, V483A, E484D, E484K, F490L, F490S, Q493R, S494P, N501Y, A520S, A522V, A522S) were inserted into the same vector described above. The A352S variant was excluded due to an error present in the gBlock. Plasmids were transformed into *S. cerevisiae* (EBY100) using the Frozen-EZ Yeast Transformation II Kit (Zymo Research) following the manufacturer's protocol and selected via the tryptophan auxotrophic marker.

Yeast-Surface Display of RBD-SD1:

For induction of RBD expression, fresh yeast cultures were inoculated at an $OD_{600}$ density of 0.2 in selective SDCAA media and grown at 30° C. and 180 rpm until cultures reached an $OD_{600}$ of 0.8 to 1.0. Next, cells were centrifuged at 2400×g for 3 minutes, resuspended in an equal volume of SGCAA (6.7 g/L Yeast Nitrogen Base, 4.0 g/L drop out amino acid mix, 0.46 g/L $NaH_2PO_4$, 0.88 g/L $Na_2HPO_4$, 7.7 g/L NaCl, 2% galactose, 2% raffinose), and incubated for 16 to 20 hours at 20° C., 200 rpm.

Antibody Binding to Yeast-Displayed RBD Variants:

To assess binding breadth, IgGs and hACE2 (expressed in a bivalent format as a C-terminal IgG1 Fc conjugate; Sino Biological, Cat #10108-H02H) were tested against the panel of 17 sarbecovirus RBDs. Initially, binding was determined at a single 100 nM concentration of IgG or hACE2. Briefly, 0.2 OD induced cells per well were aliquoted into 96-well plates and washed out of SGCAA media with PBSF. Next, cells were resuspended in 100 µl of 100 nM IgG or hACE2 and incubated at room temperature for 30 minutes. Cells were subsequently washed twice with PBSF and labeled with 50 µl of allophycocyanin (APC)-conjugated monoclonal mouse anti-hemagglutinin tag (HA).11 antibody (BioLegend, Cat #901524), phycoerythrin (PE)-conjugated goat anti-human IgG polyclonal antibodies (Southern Biotech, Cat #2040-09), and propidium iodide (Invitrogen, Cat #P1304MP) for 20 minutes on ice. For each sarbecovirus RBD, a secondary reagent control was included. Cells were washed twice with PBSF before analyzing via flow cytometry on a BD FACS Canto II (BD Biosciences).

To account for differences in RBD expression across sarbecoviruses, binding signal was normalized to HA-tag signals ($MFI_{anti-human\ IgG\ PE}/MFI_{anti-HA\ APC}$). Binding with normalized ratios below 1.0 were considered non-binding (NB) at the concentration tested. Those with ratios above 1.0 were titrated to calculate their apparent binding affinity ($K_D^{APP}$).

Titrations were performed as 2-fold dilution series from 100 nM to 0.048 nM IgG or hACE2 as described above to obtain $K_D^{APP}$ values. Mean anti-human IgG PE MFI signal was normalized from 0 to 100 ($MFI_{[ADI-58124\ or\ hACE2\ concentration]} - MFI_{minimum}) * 100/(1 - MFI_{minimum})$ and fitted as nonlinear regression curves in GraphPad Prism using the following equation: $Y = Y_{x=min} + X*(Y_{x=max} - Y_{x=min})/(K_D^{APP} + X)$, where X is the IgG or hACE2 concentration and Y is the normalized binding signal. Points displaying hook effects, defined as PE MFI collected at concentrations higher than that of the maximum MFI concentration, were excluded from analysis. $K_D^{APP}$ (nM) for inventive antibodies and clinical antibodies and hACE2 are displayed as a heatmap (FIG. 40B).

To maximize the dynamic range of potential differences in binding affinity to SARS-CoV-2 variants, binding experiments were conducted at each antibody's respective SARS-CoV-2 $K_D^{APP}$ Binding signal was normalized using the following equation: $MFI_{anti-hu\ IgG\ PE}/MFI_{anti-HA\ APC} - MFI_{background\ anti-hu\ IgG\ PE}/MFI_{background\ anti-HA\ APC}$, and calculated as a percentage of normalized signal of the reference WT SARS-CoV-2 strain RBD-SD1.

Example 27: Further Analyses on Antigen Recognition by Post-Affinity Maturation Antibodies First, to gain further insight into the antigenic surface recognized by ADI-58124, a mutagenized yeast surface-display RBD library was generated and rounds of selection were performed to identify RBD variants that displayed loss of binding to ADI-58124 (FIGS. 41A-41C). A final round of positive selection was performed using a mixture of recombinant hACE2 and two RBD-directed mAbs (S309 and CR3022) that target non-overlapping epitopes distinct from the ADI-58124 binding site to exclude mutations that globally disrupt the conformation of the RBD (D. Pinto et al., Nature 583, 290-295 (2020); M. Yuan et al., Science 368, 630-633 (2020)). Selected RBD mutants encoding single amino acid substitutions were individually tested for binding to ADI-58124, recombinant hACE2, CR3022, and S309 to confirm site-specific knock-down mutations (FIGS. 41B and 41D). Substitutions at only four RBD positions specifically abrogated ADI-58124 binding: D405E, G502E/R/V, G504A/D/R/S/V and Y505C/N/S (FIGS. 41E-41F). These four residues are remarkably conserved among the clade I sarbecovirus subgenus and invariant among SARS-CoV-1, SARS-CoV-2, SHC014 and WIV1 viruses (FIG. 41G), providing a molecular explanation for the breadth of binding and neutralization exhibited by ADI-58124. Consistent with the conservation of these residues among clade I sarbecoviruses, none of the substitutions that impacted ADI-58124 binding were present in full-length SARS-CoV-2 sequences deposited in the GISAID database as of Oct. 19, 2020. Notably, 3 of the 4 identified mutations that abrogate ADI-58124 binding lie within the hACE2 binding site (Lan J. et al., Nature. 2020 May; 581(7807):215-220)) and at least one mutation at each position (G502E/R/V, G504V and Y505C/N/S) also abrogated hACE2 binding (FIGS. 41E-41F), likely accounting for their absence among circulating SARS-CoV-2 isolates. These results suggest that the evolutionary conservation of the ADI-58124 epitope is likely directly linked to ACE2 binding.

Next, to further understand the epitope of ADI-58120, ADI-58124, ADI-58126, ADI-58128, and ADI-58130, antibody-resistant SARS-CoV-2 S protein was induced using recombinant vesicular stomatitis virus encoding the SARS-CoV-2 S protein (rVSV-SARS-CoV-2-S, from Wuhan-Hu-1 isolate) as a surrogate recombinant screening system. Pre-titrated rVSV-SARS-CoV-2-S was mixed with serially diluted amounts of test antibodies and incubated with Vero cells and repeatedly passaged. Neutralization assay was performed with the potentially resistant virus obtained from the final passage.

Neutralization of mutant SARS-CoV-2 S-comprising pseudovirus (rVSV) by ADI-58120, ADI-58124, ADI-58126, ADI-58128, and ADI-58130 are provided in FIGS. 41H-41J. Based on the increase in the IC50 values shown in FIGS. 41H-41J, N440H and N440D substitutions in the S protein independently conferred resistance to neutralization by ADI-58120, G504D and G504S substitutions independently conferred resistance to neutralization by ADI-58124, T415I substitution conferred resistance to neutralization by ADI-58126, F490S substitution conferred resistance to neutralization by ADI-58128, and Y145D, K150E, and W152R substitutions independently conferred resistance to neutralization by ADI-58130. Accordingly, residue 440 is a proposed epitope residue for ADI-58120, residue 504 is a proposed epitope residue for ADI-58124, residue 415 is a proposed epitope residue for ADI-58126, residue 490 is a proposed epitope residue for ADI-58128, and residues 145, 150, and 152 are proposed epitope residues for ADI-58130.

Methods used for the RBD yeast library-based study and the antibody-resistant S protein selection study for ADI-58124 are provided below. Essentially the same methods were used for ADI-58120, ADI-58126, ADI-58128, and ADI-58130.

ePCR Library Construction and Selection of RBD Mutants:

SARS-COV-2 RBD-SD1 gBlock (IDT) was amplified by polymerase chain reaction (PCR) with iProof High-Fidelity PCR system (Bio-Rad, Cat #1725310) following the manufacturer's recommendations. The amplified DNA was purified (Nucleospin Gel and PCR Clean-up Kit, Macherey-Nagel, Cat #740609.250) and subsequently mutagenized by error-prone PCR(ePCR) using the GeneMorph II Random Mutagenesis Kit (Agilent Technologies, Cat #200550) with a target nucleotide mutation frequency of 0-4.5 mutations per kilobase of DNA. The mutagenized DNA product was cloned into yeast via electroporation as described earlier. The ePCR library was validated by plating a subset of the transformed ePCR yeast library on tryptophan dropout agar plates (Teknova, Cat #C6099) and Sanger sequencing clonal yeast cells. The WT SARS-CoV-2 RBD-SD1, cloned as described earlier, was used as a reference in subsequent selection efforts.

Prior to performing FACS selection, ePCR RBD-SD1 library and WT RBD-SD1 yeast were induced as described above. To select for mutants with diminished binding to ADI-58124, yeast cells were stained with ADI-58124 in a similar format as described above. Briefly, induced cells were incubated for 30 minutes on ice with ADI-58124 IgG diluted in PBSF to its $EC_{80}$ concentration, which was determined by titrating ADI-58124 on yeast-displayed WT RBD-SD1 (FIGS. 41A-41D). Cells were then washed twice in PBSF, stained in a secondary staining mixture and analyzed on a BD FACS Aria II (Becton Dickerson). A subset of yeast population exhibiting HA-tag expression but reduced ADI-58124 binding relative to WT RBD-SD1 yeast, as shown in FIG. 40A, were sorted and propagated in SDCAA media for 48 hours at 30° C. This selection procedure was repeated for a second round to further enrich yeast encoding ADI-58124 binding knock-down mutations. In the final round of selection, the induced library was stained with a mixture of hACE2, S309 and CR3022 at their respective $EC_{80}$ concentrations. The subset of the stained population that mirrored the binding profile of WT RBD-SD1-stained yeast was sorted and plated on agar plates for Sanger sequencing of single colonies. Individual clones possessing single amino acid substitutions identified from sequencing were cultured, induced, and evaluated for binding to ADI-58124, S309, CR3022 and soluble hACE2 at their respective $EC_{80}$ concentrations through flow cytometric analysis on the BD FACS Canto II (BD Biosciences). Binding signal was normalized and calculated as a percentage of the binding signal to reference WT RBD-SD1, as described earlier.

Mutant SARS-CoV-2 S-Comprising Pseudovirus rVSV Escape Study:

The concentration that gives 90% of the maximum inhibition (IC90) for ADI-58124 was estimated in a 9-point neutralization assay. Briefly, a pre-titrated amount of rVSV-SARS2 S virus was incubated with serial dilutions of ADI-58124 for 1 hour at room temperature. For screening the antibody-virus mixture was applied to monolayers of Vero cells in a 96-well plate. Following a 7-hour incubation, eGFP-positive virus-infected cells were enumerated using a Cytation-5 imager (Biotek) and analyzed with the onboard Gen5 software, version 3.04 (Biotek).

Vero cells were plated in a 12-well plate the day before selection with the antibody so that cells would reach ~80% confluency the next day. Parental rVSV-SARS-CoV-2 S virus was titrated to obtain a viral infection of ~2% in the 12-well plate at 8 hours after infection. The next day, ADI-58124 was incubated at the estimated IC90 with different multiplicity of infections (increasing by 3-fold for 3 different treatments) of the rVSV-SARS-CoV-2 S virus at room temperature for 1 hour. The same 3 concentrations of virus were also tested in wells with no ADI-58124, but vehicle, phosphate buffered saline, as controls. Vero cells were infected with the virus and ADI-58124 mixtures. The plates were monitored for signs of eGFP expression at 8 to 10 hours after infection and every 12 hours thereafter. The virus was harvested approximately 2 to 3 days after infection, when most of the cells were infected in the ADI-58124-treated wells. The supernatant was centrifuged at 15,000 rpm for 1 minute at 4° C. to get rid of cell debris, then aliquoted and stored at 80° C.; the virus harvested was Passage 1 (P1) of the selection with ADI-58124 to find potential antibody-resistant rVSV-SARS-CoV-2 S virus.

For P2, virus from the well with lowest virus inoculum was incubated with twice the concentration of ADI-58124 selected for the assay for P1. The mixtures were incubated and then added to the Vero cells and harvested as described for P1. The selection protocol was repeated until 3 passages were conducted, at which point a neutralization assay to compare parental virus and the potentially resistant virus population to estimate resistance to ADI-58124 was performed. Single viral clones were plaque-purified when the viral population shows a shift of 10-fold or more in the IC50 for neutralization of ADI-58124. The plaque-purified virus was amplified on Vero cells in the presence of an IC90 concentration of antibody to prevent any potential reversion to the parental genotype. Purified viral clones were incubated with ADI-58124 to verify resistance to the antibody, as compared to the parental virus in a neutralization assay as described above. RNA was extracted from 700 µL supernatant of resistant clones using RNeasy Mini Kit (Qiagen, Cat. No. 74136) as per manufacturer's instructions. The S gene was amplified by RT-PCR using the SuperScript® III First-Strand Synthesis Kit (Invitrogen, Cat. No. 18080051) and PCR products were gel-purified by using the QIAQuick Gel Extraction Kit (Qiagen, Cat. No. 28706) following the manufacturer's protocols. Gel-purified PCR product was sent out to Genewiz (South Plainfield, N.J.) for Sanger sequencing to identify the genotype.

Example 28: SARS-CoV-2-S Binding Competition Analyses

Figure 42A:
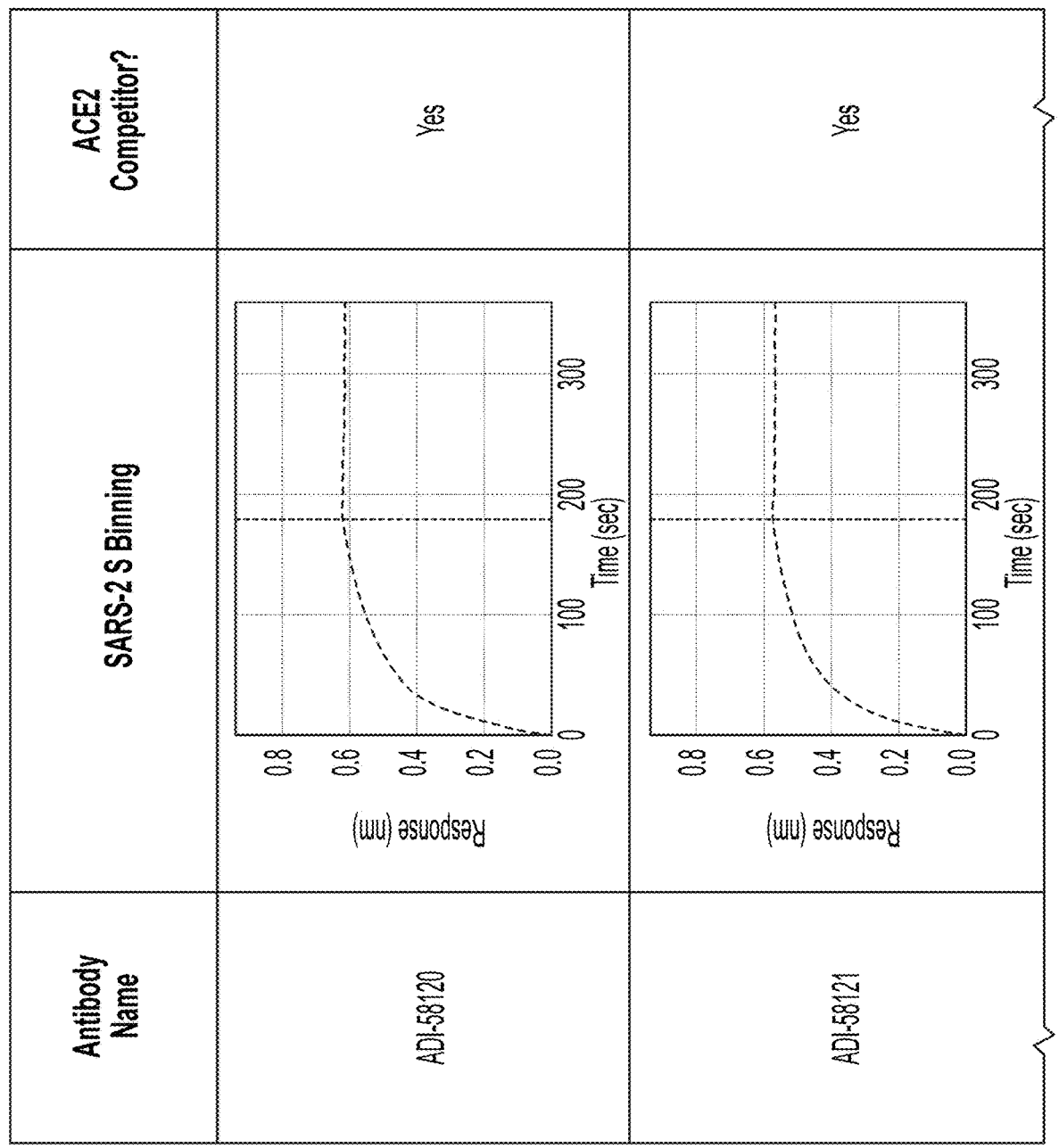
Figure 42A:
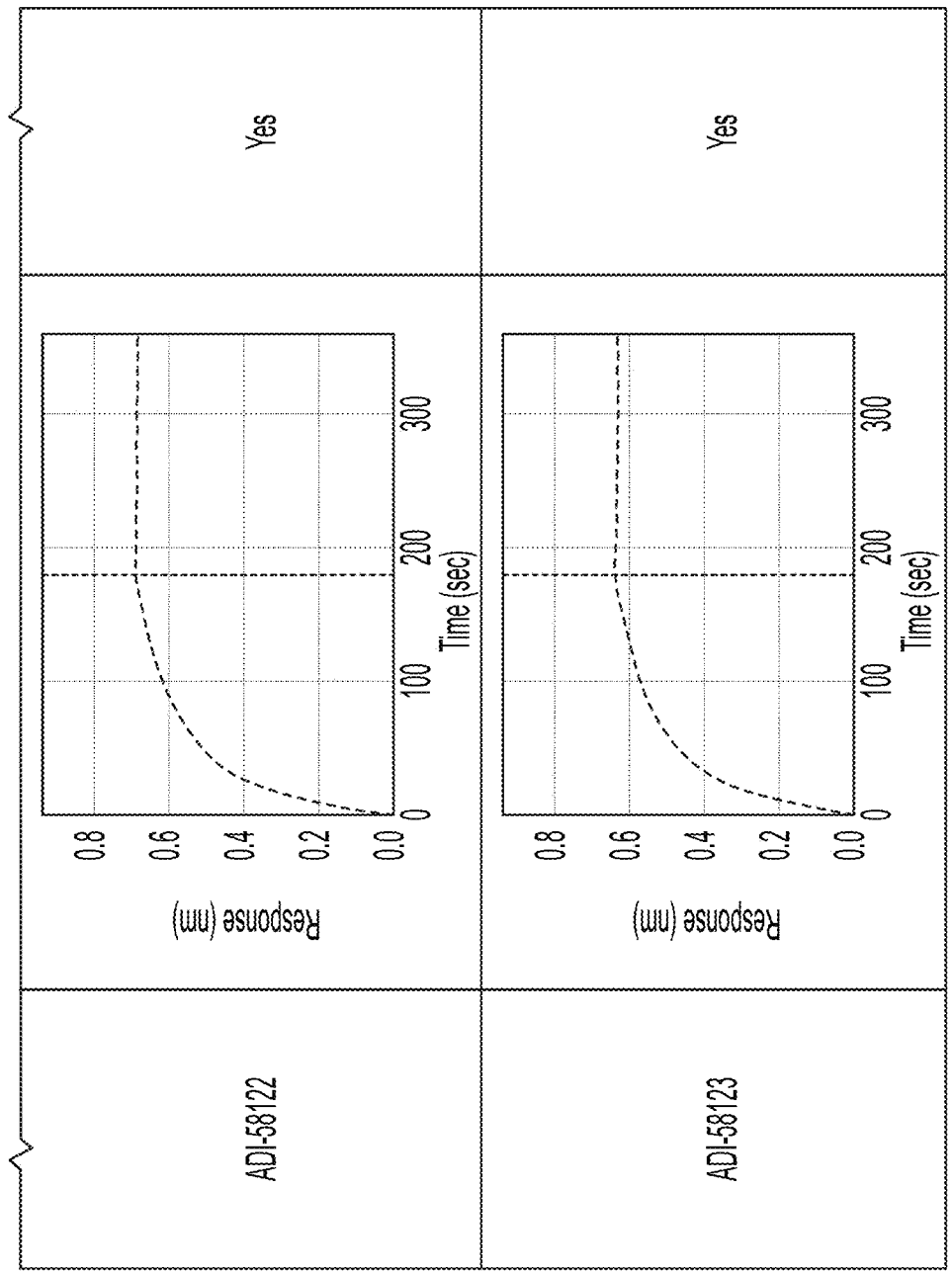
Figure 42A:
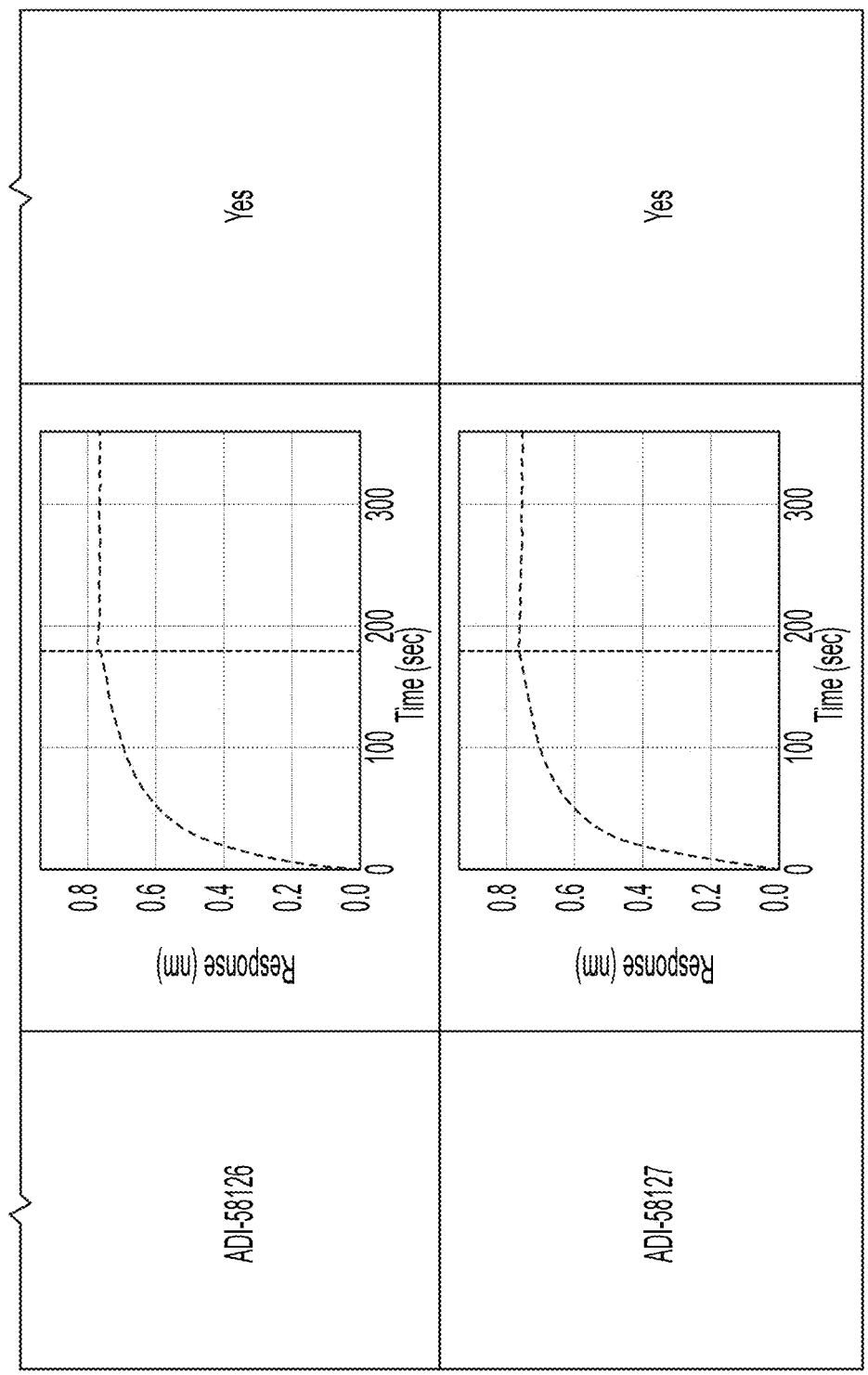
Figure 42B:
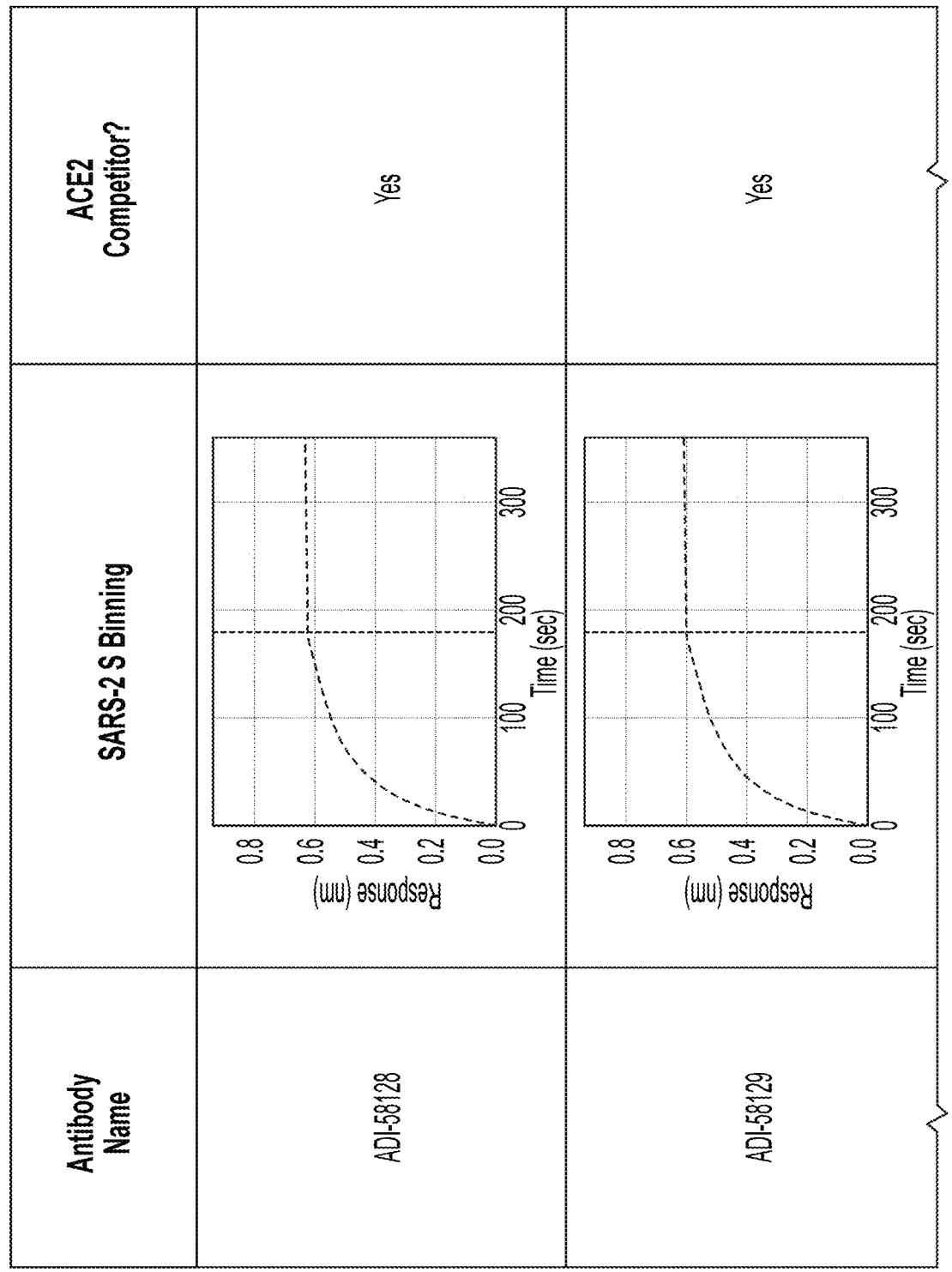
Figure 42B:
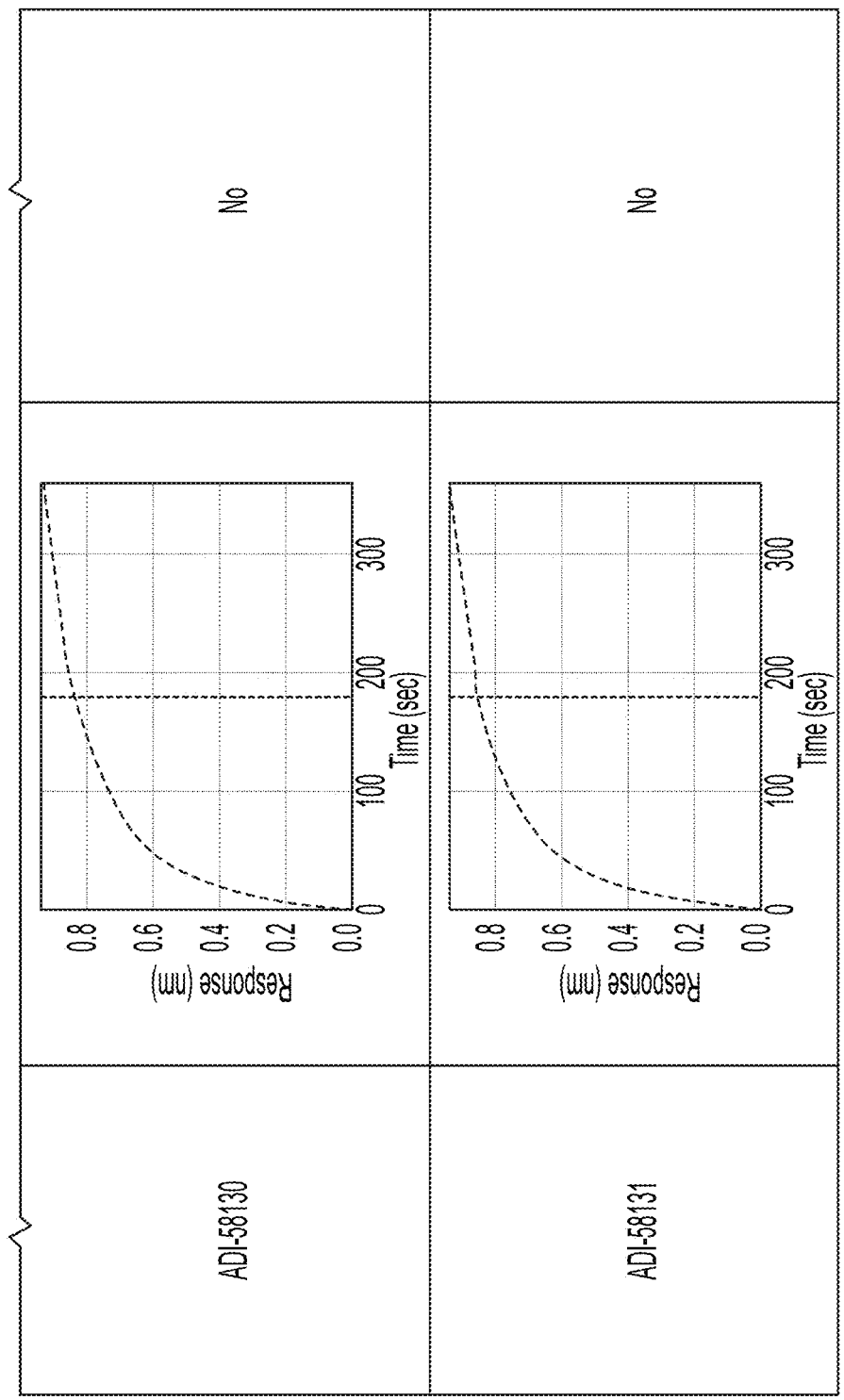
Figure 42B:
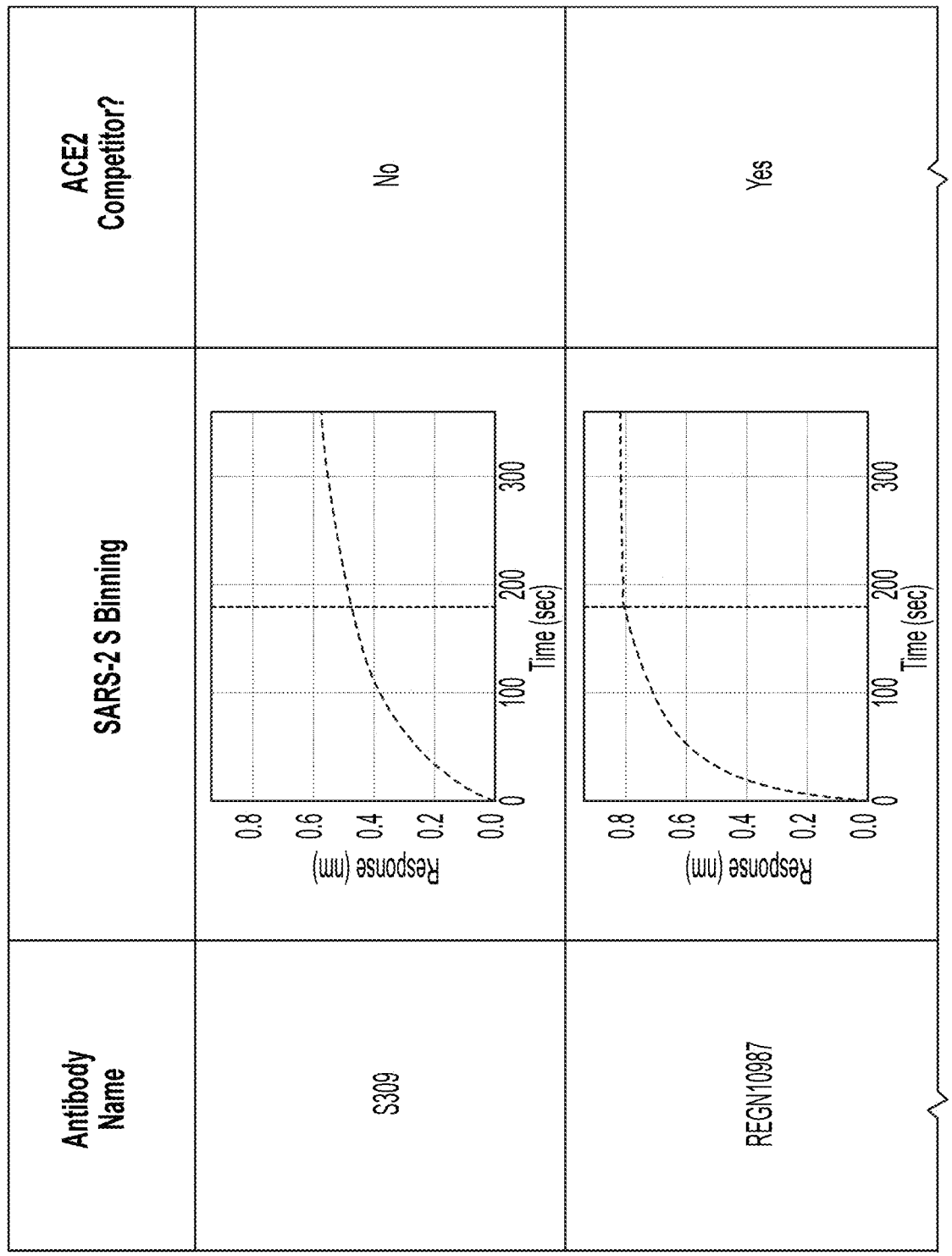
Figure 42B:
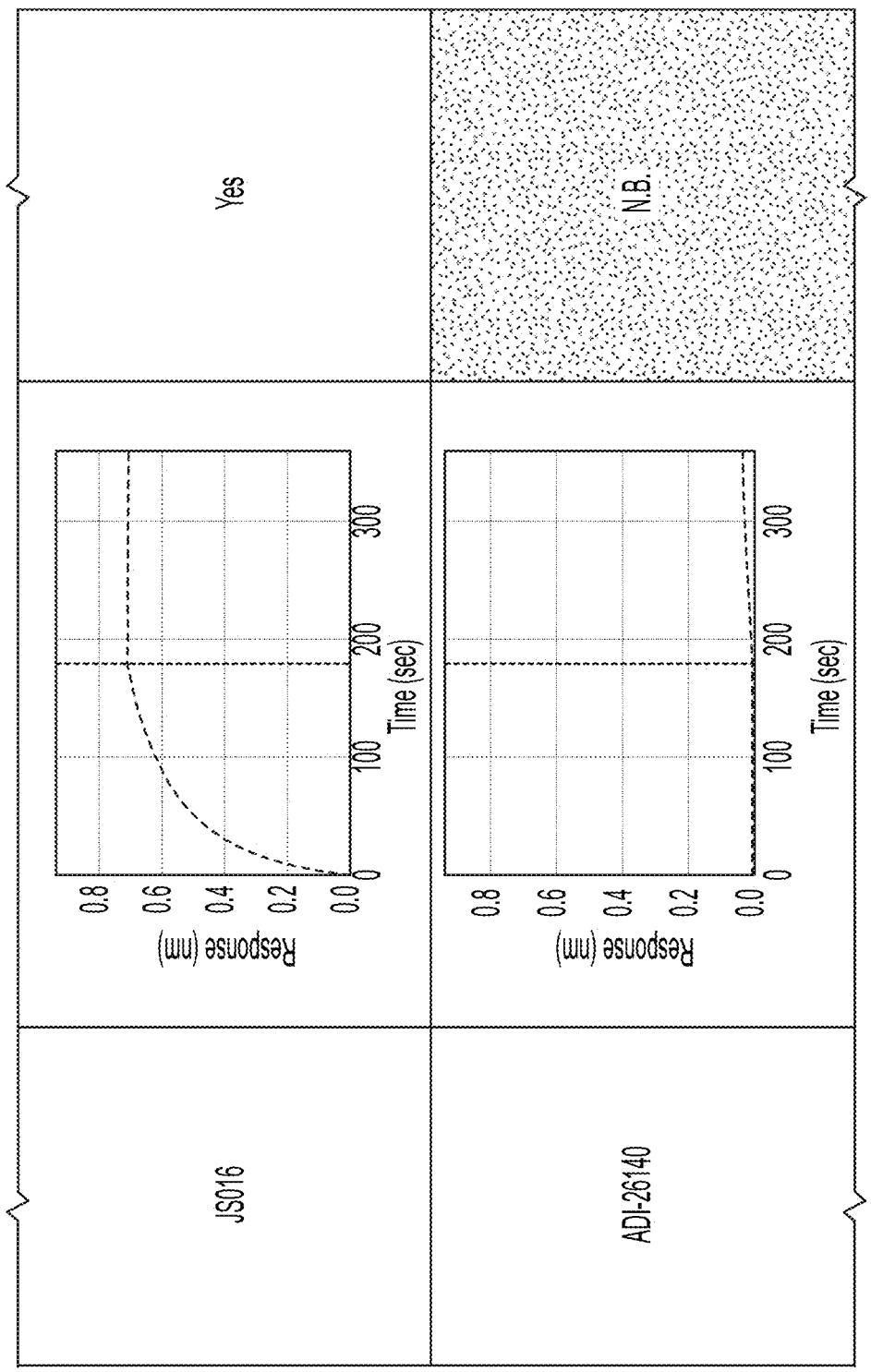
Figure 42B:
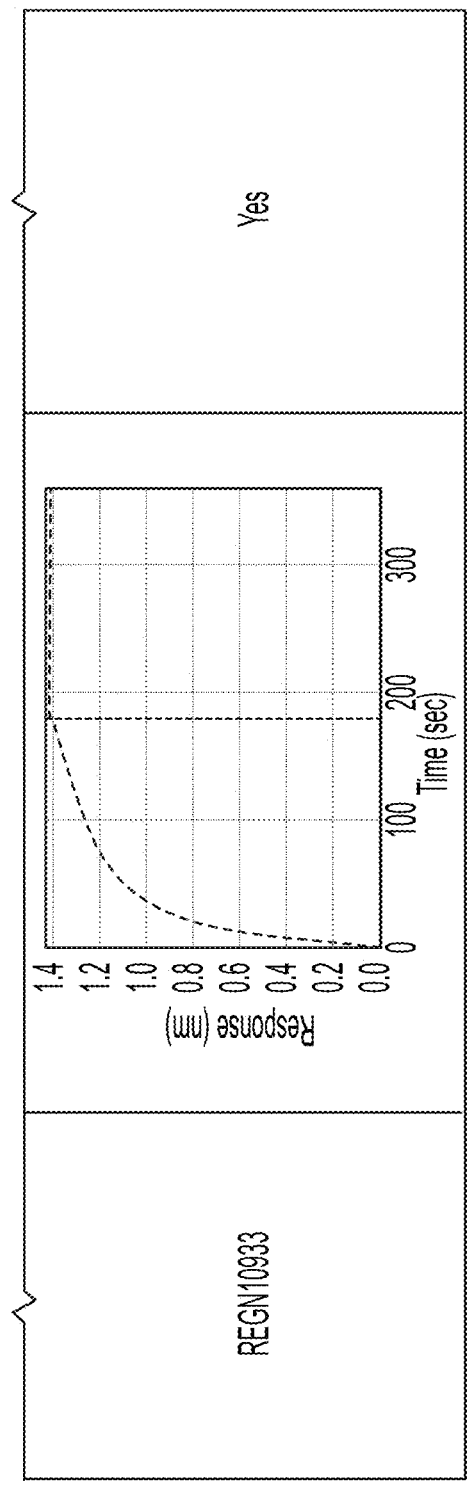
Figure 42C:
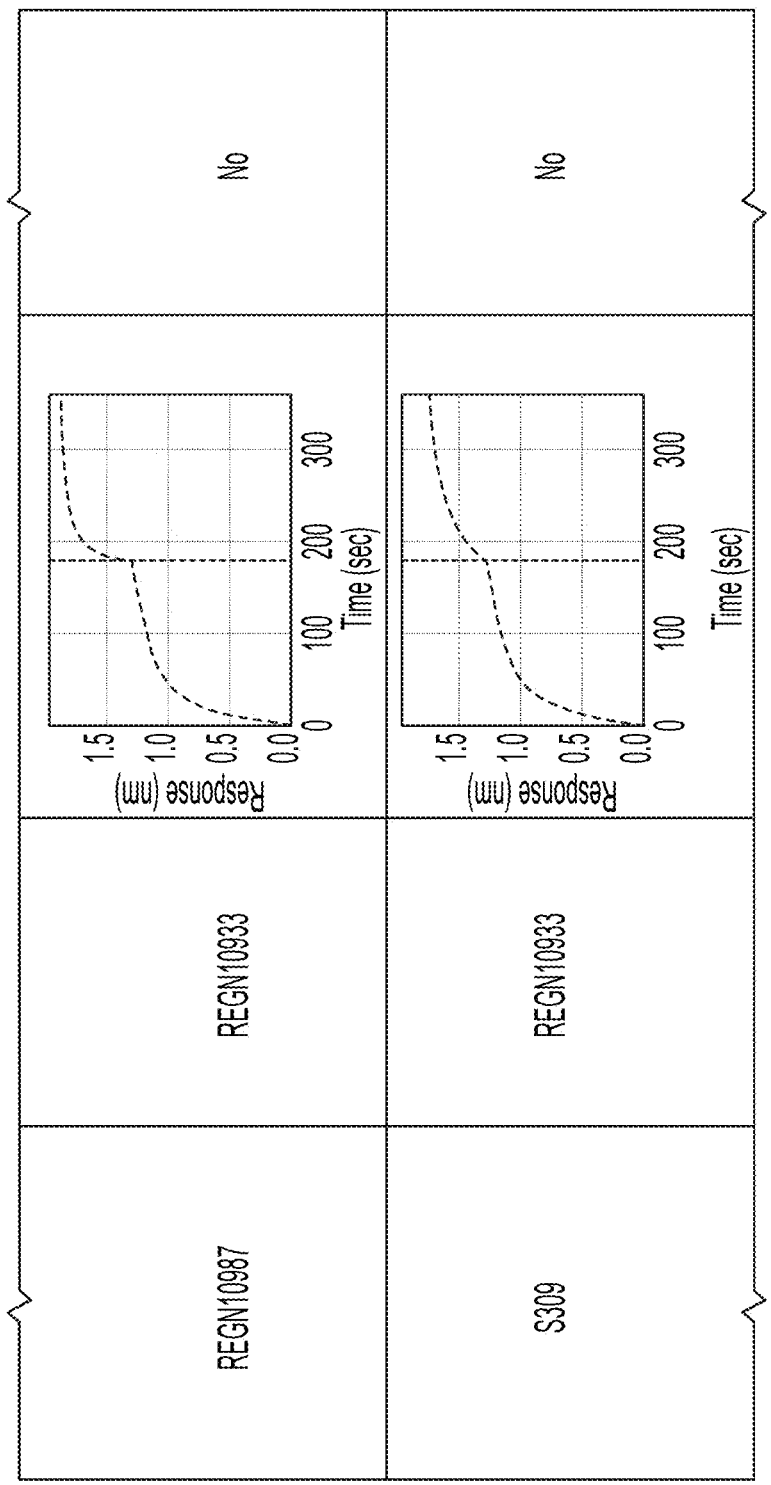
Figure 42C:
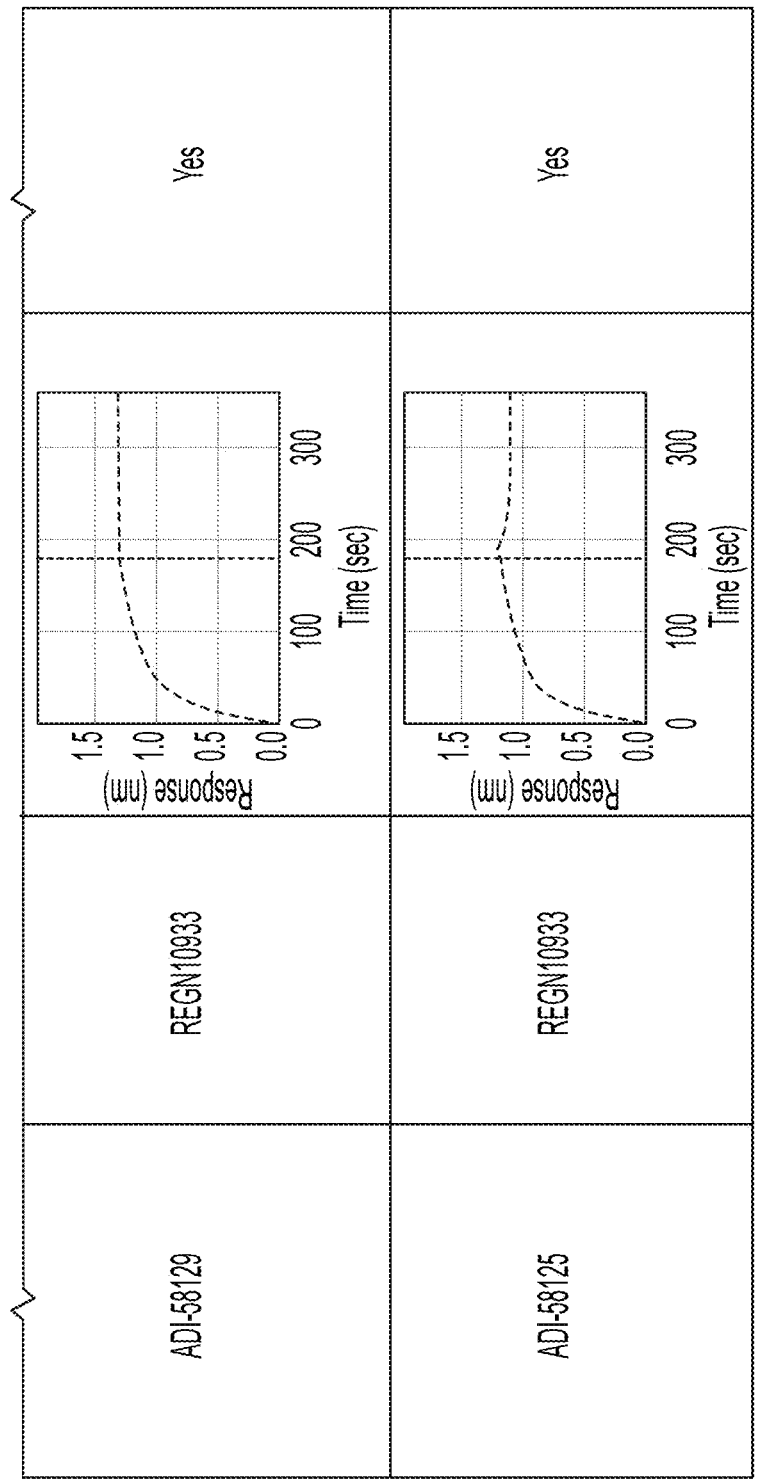
Figure 42C:
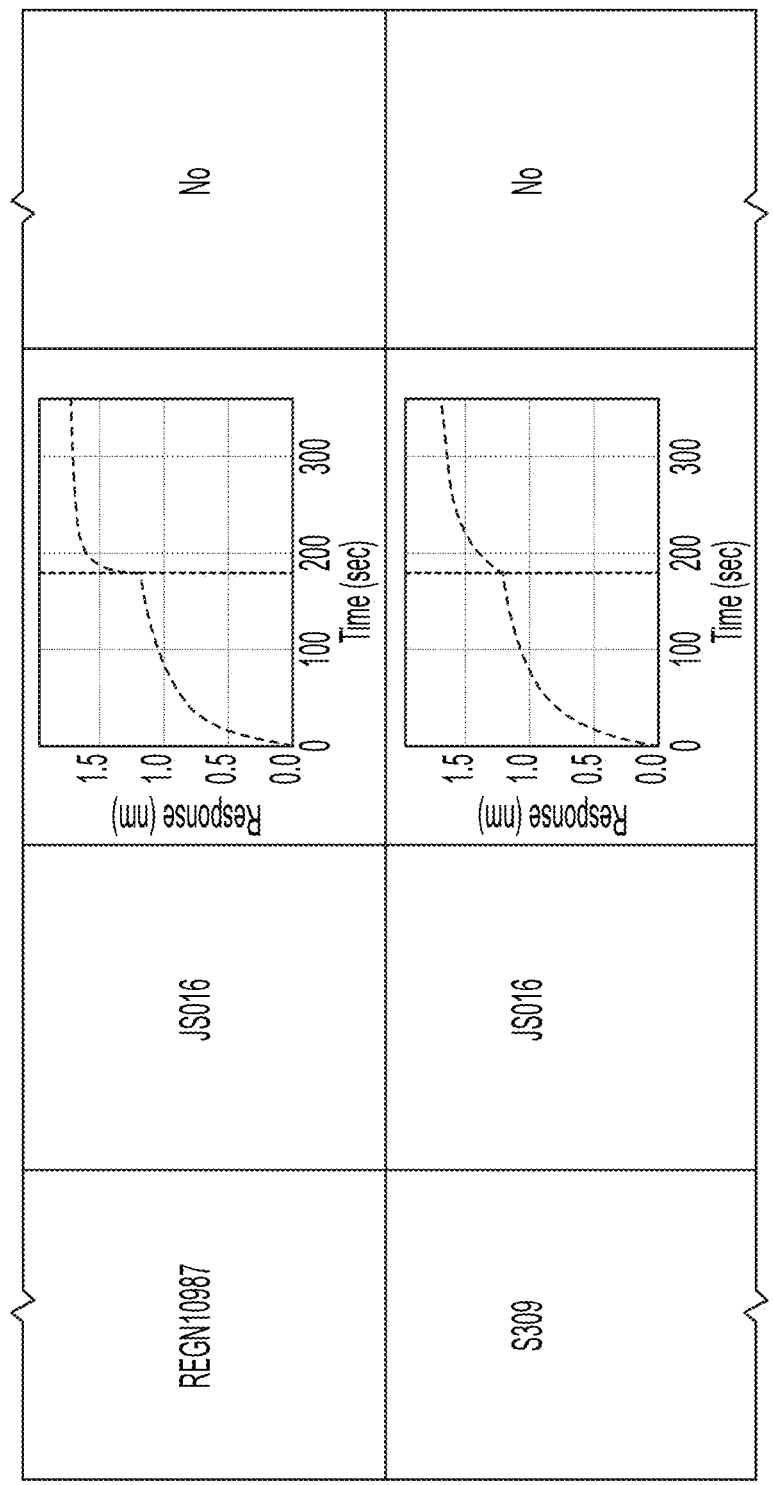
Figure 42C:
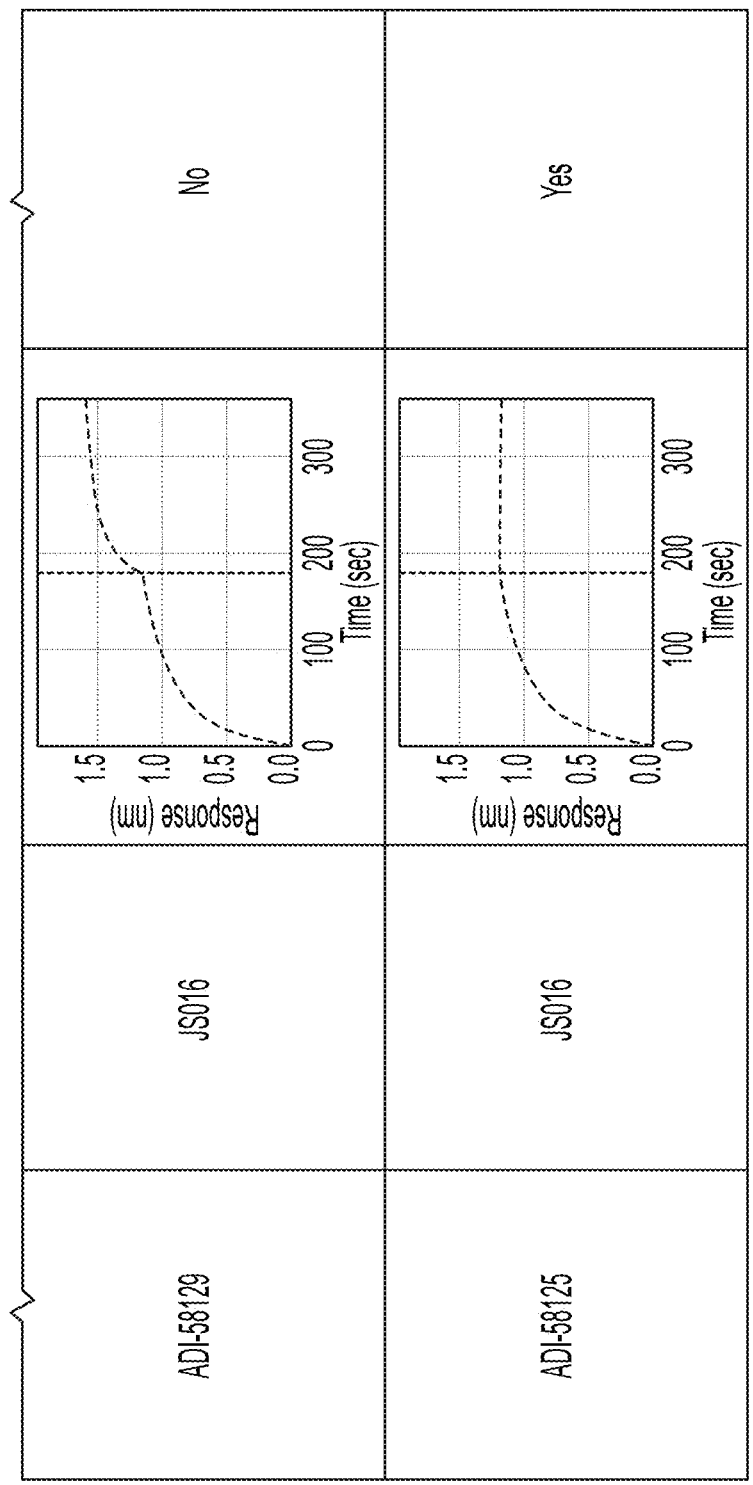
Figure 42D:
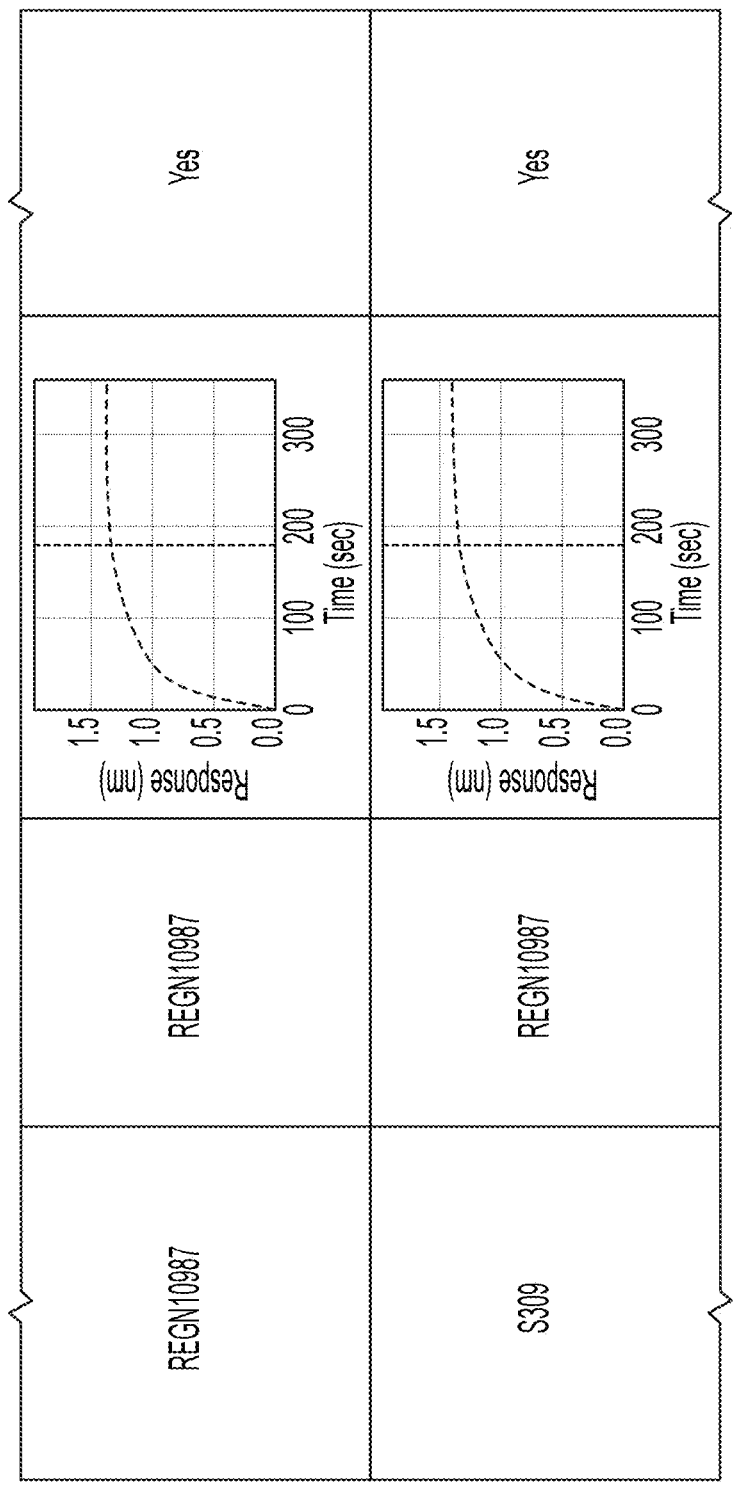
Figure 42D:
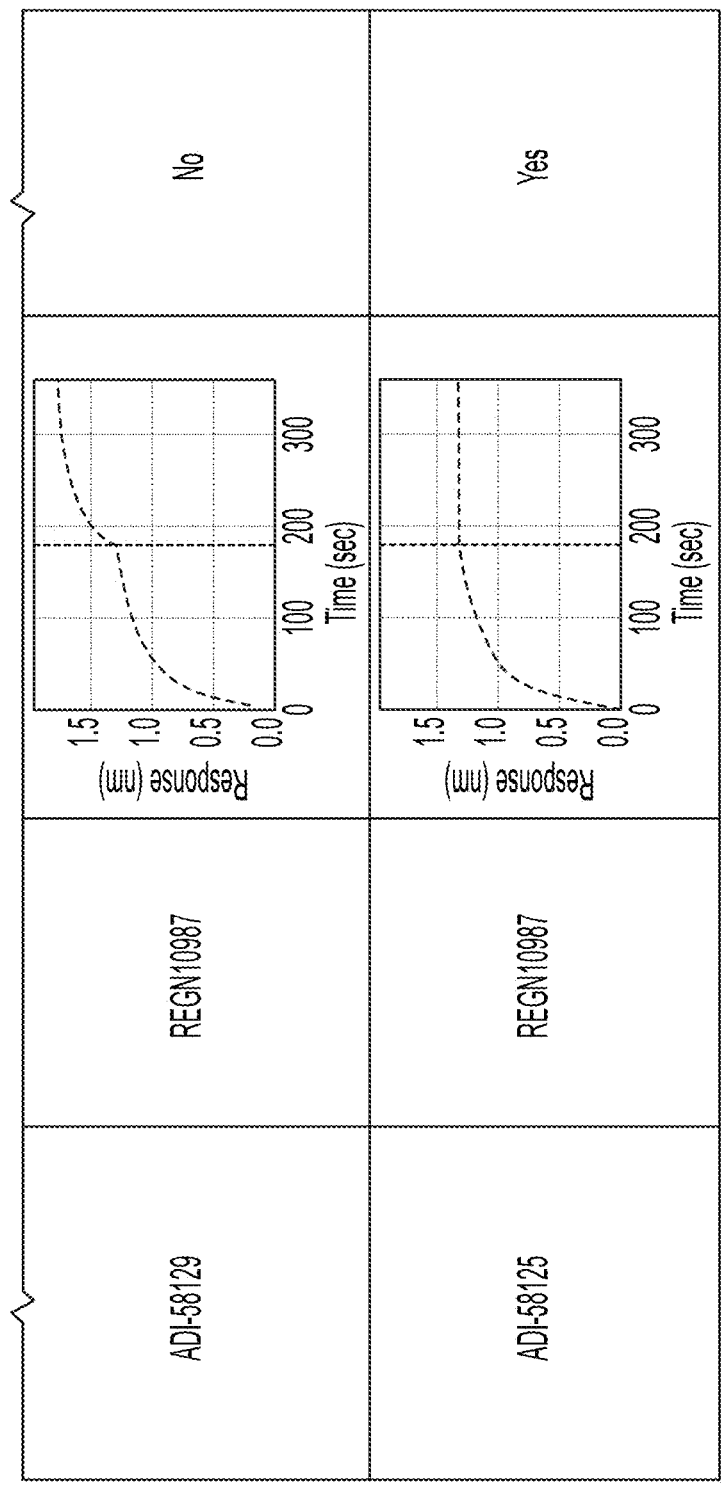
Figure 42D:
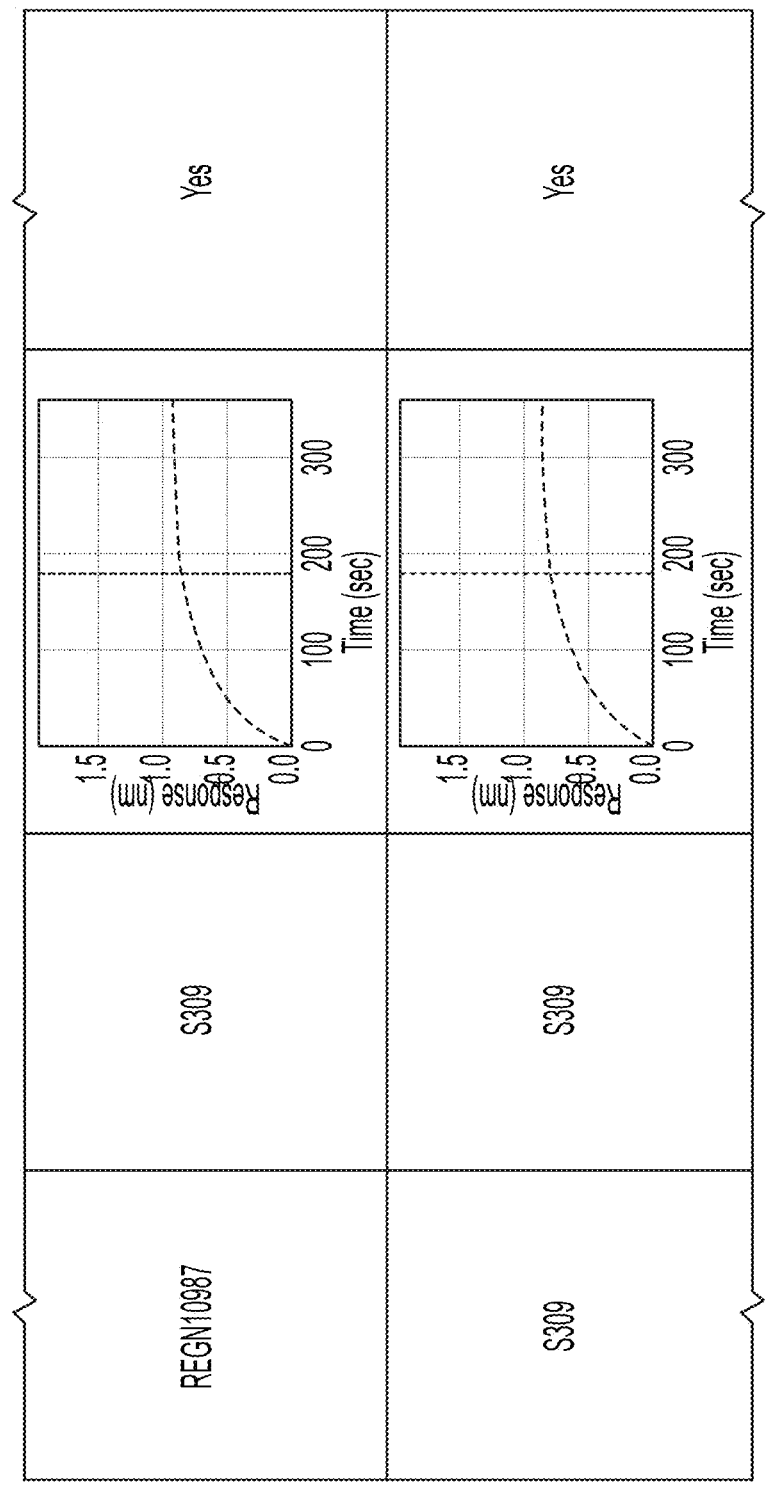
Figure 42D:
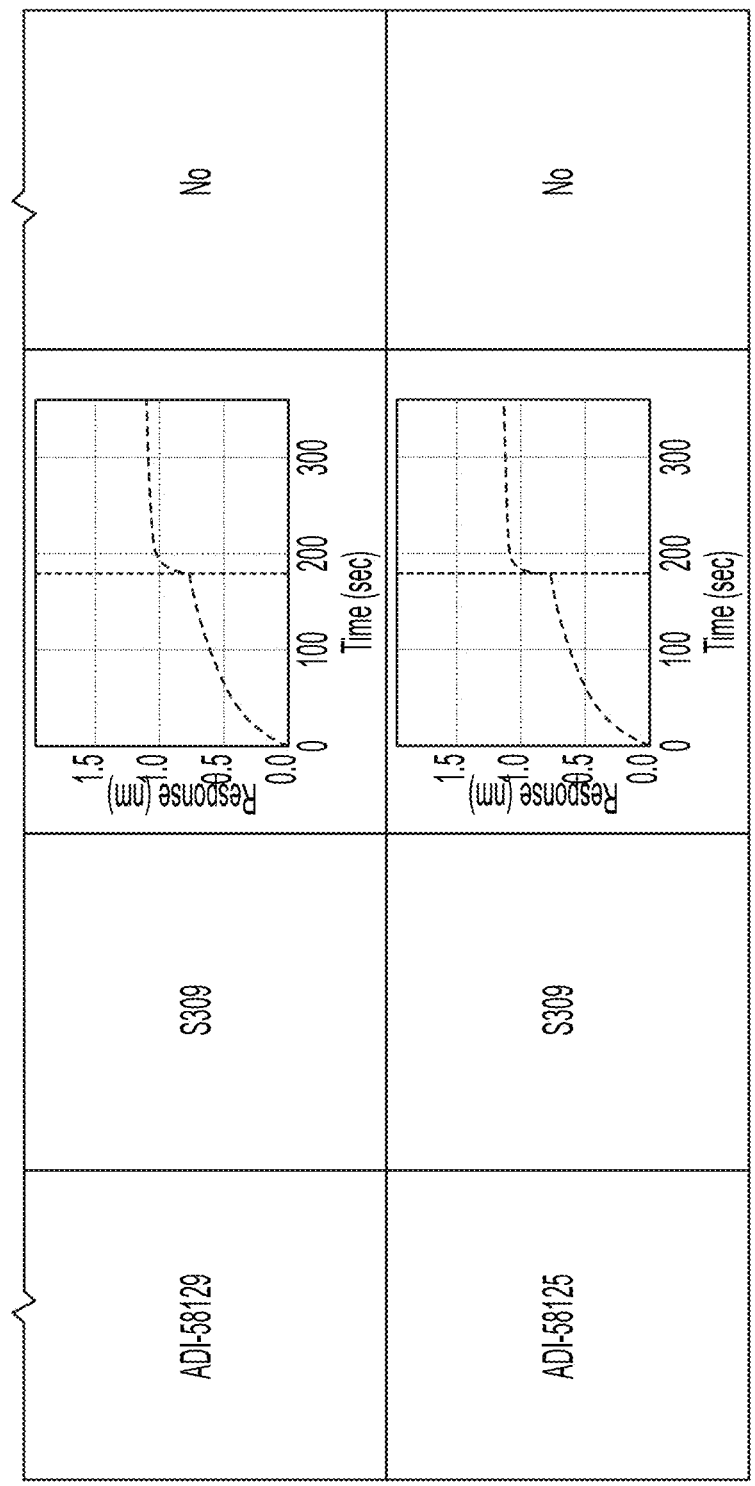
Figure 42E:
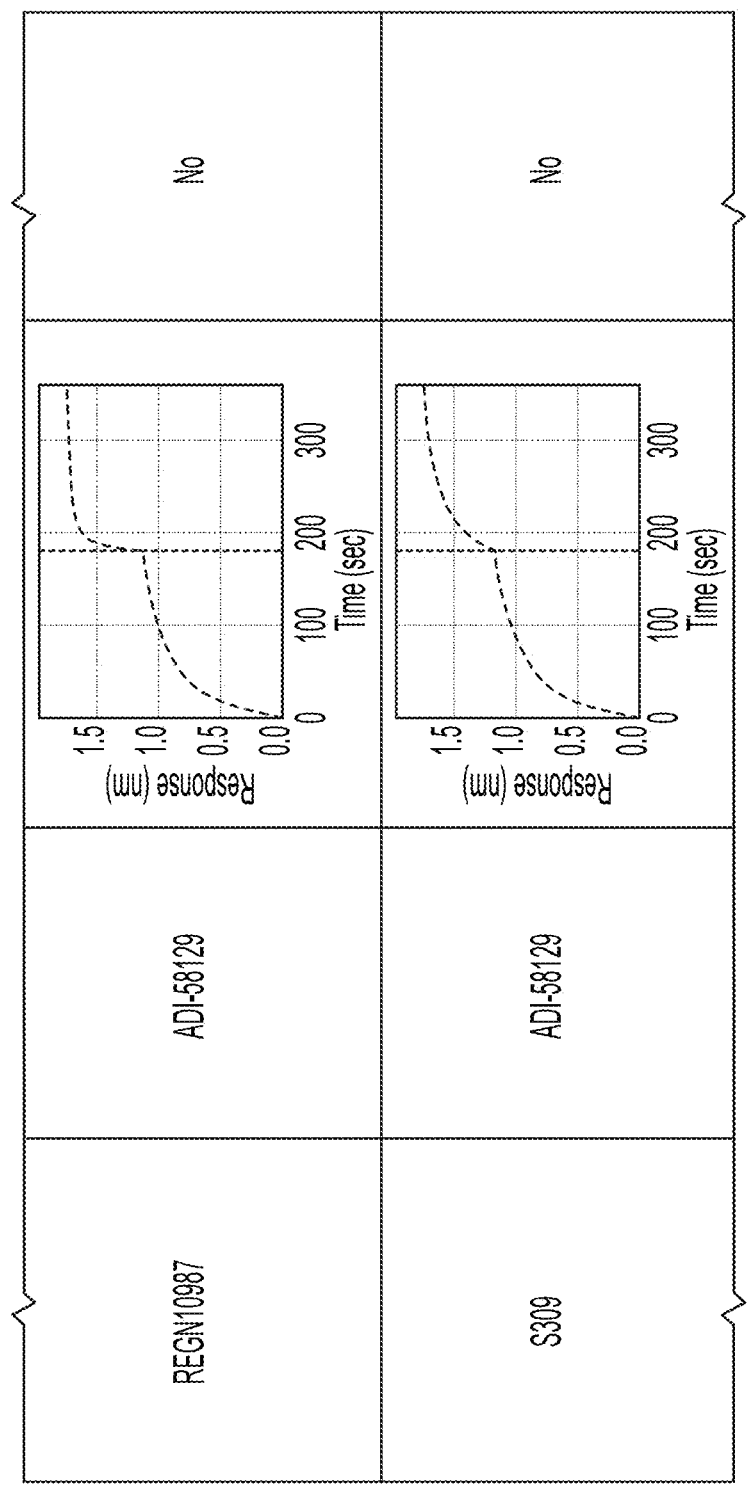
Figure 42E:
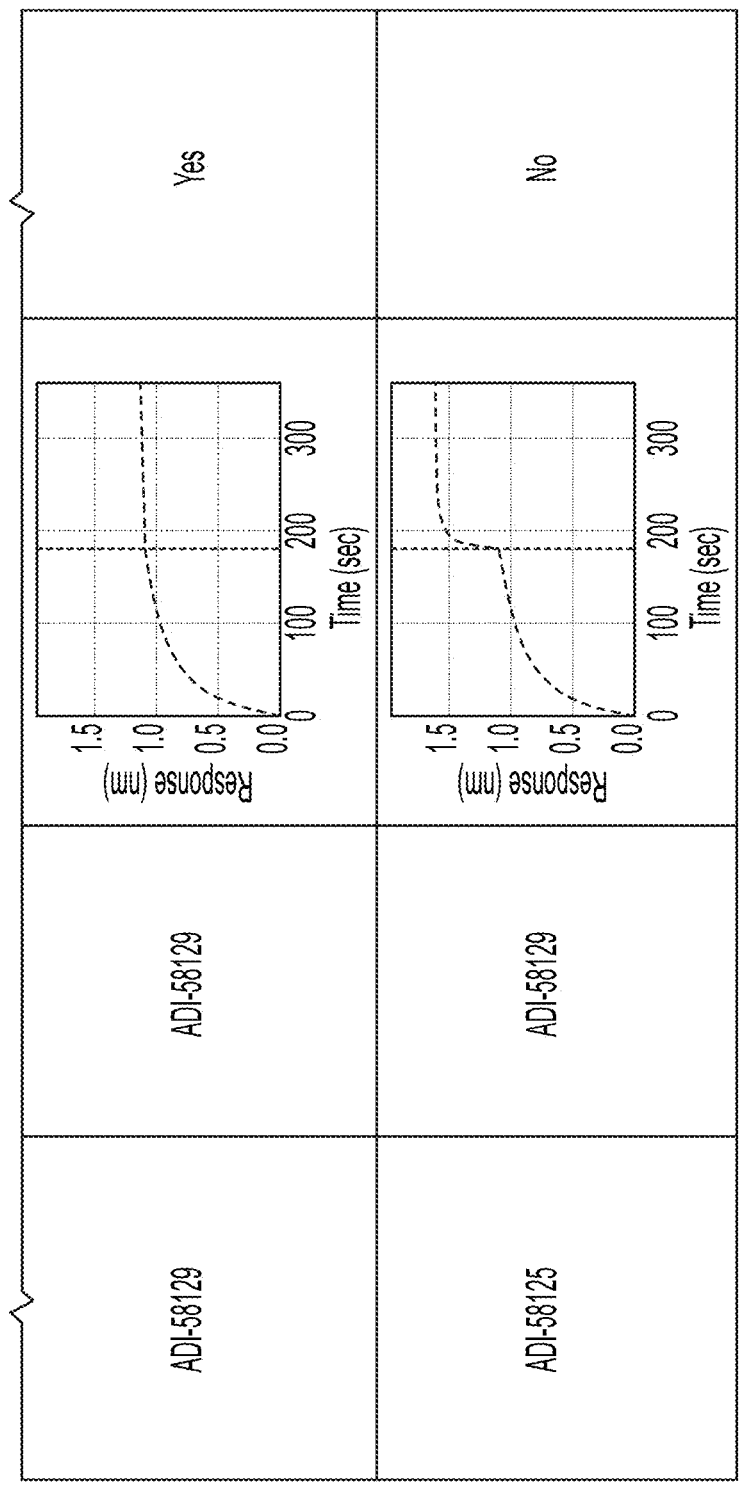
Figure 42E:
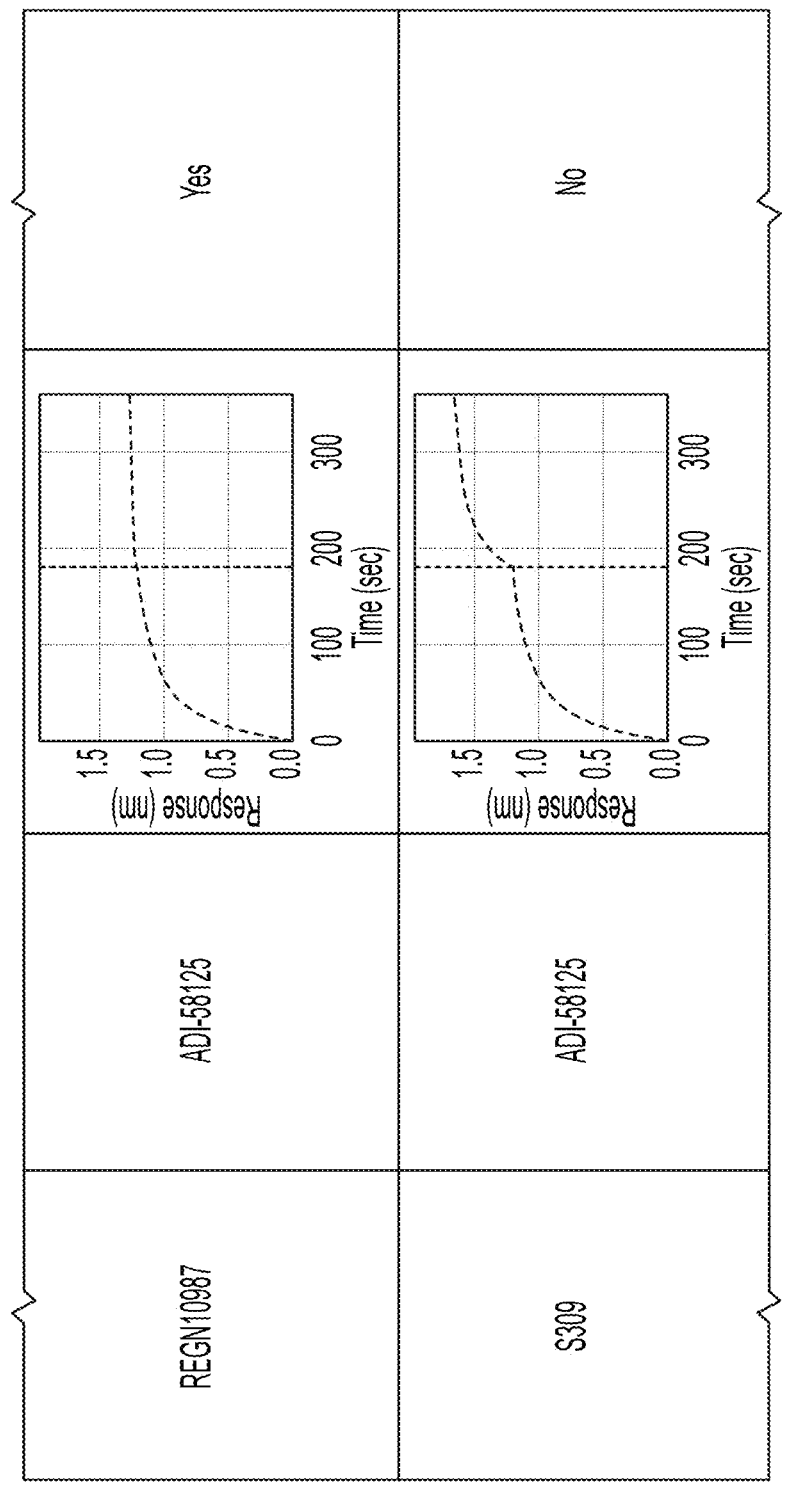
Figure 42E:
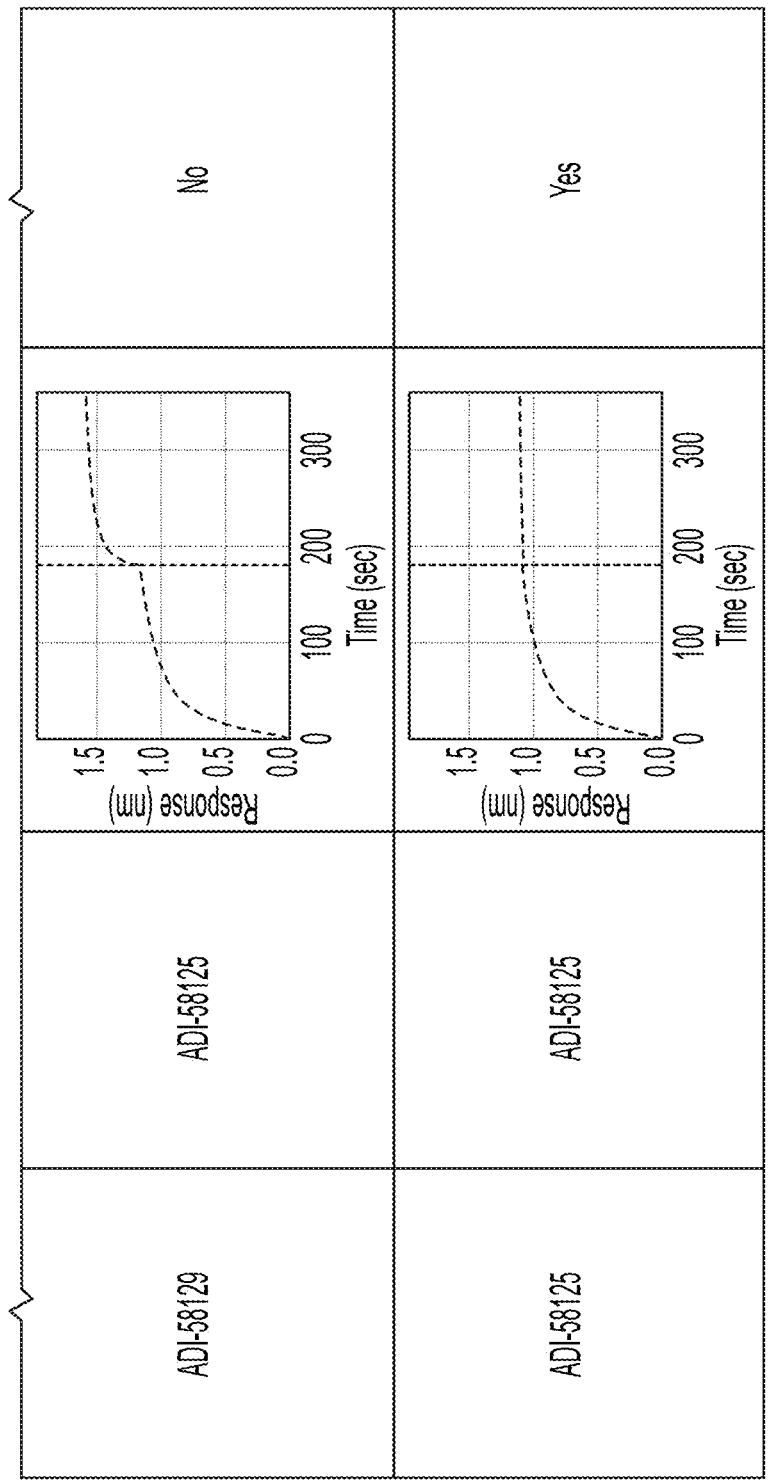
Figure 42F:
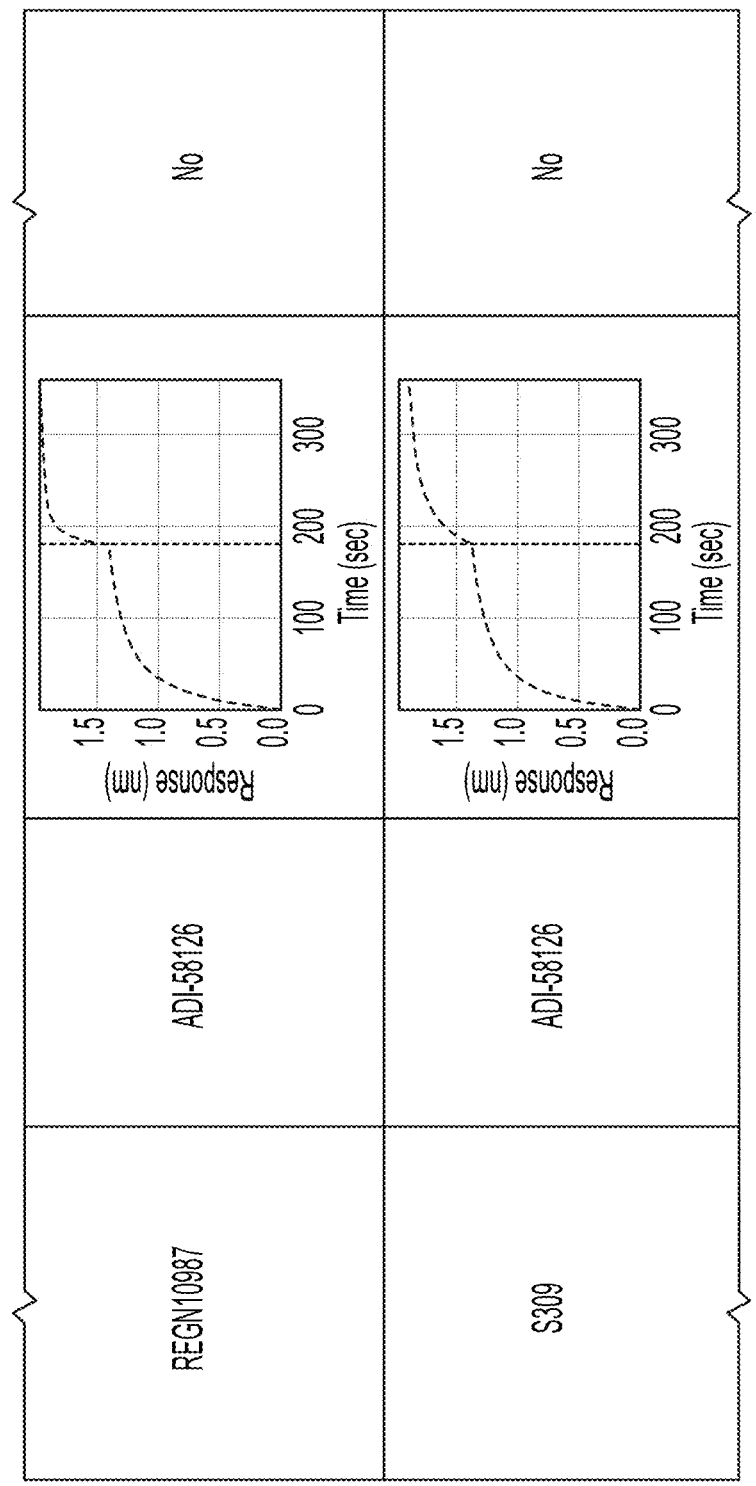
Figure 42F:
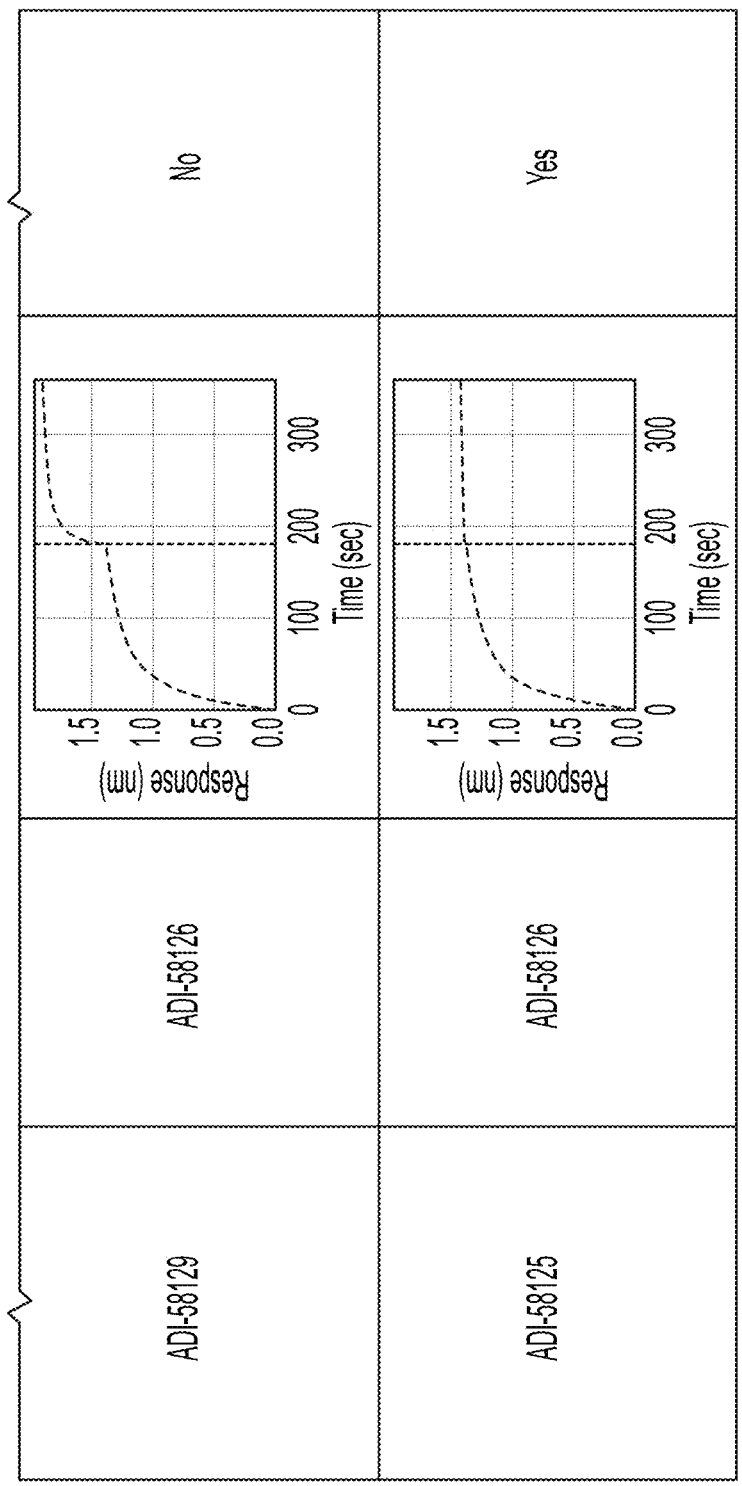
Figure 42F:
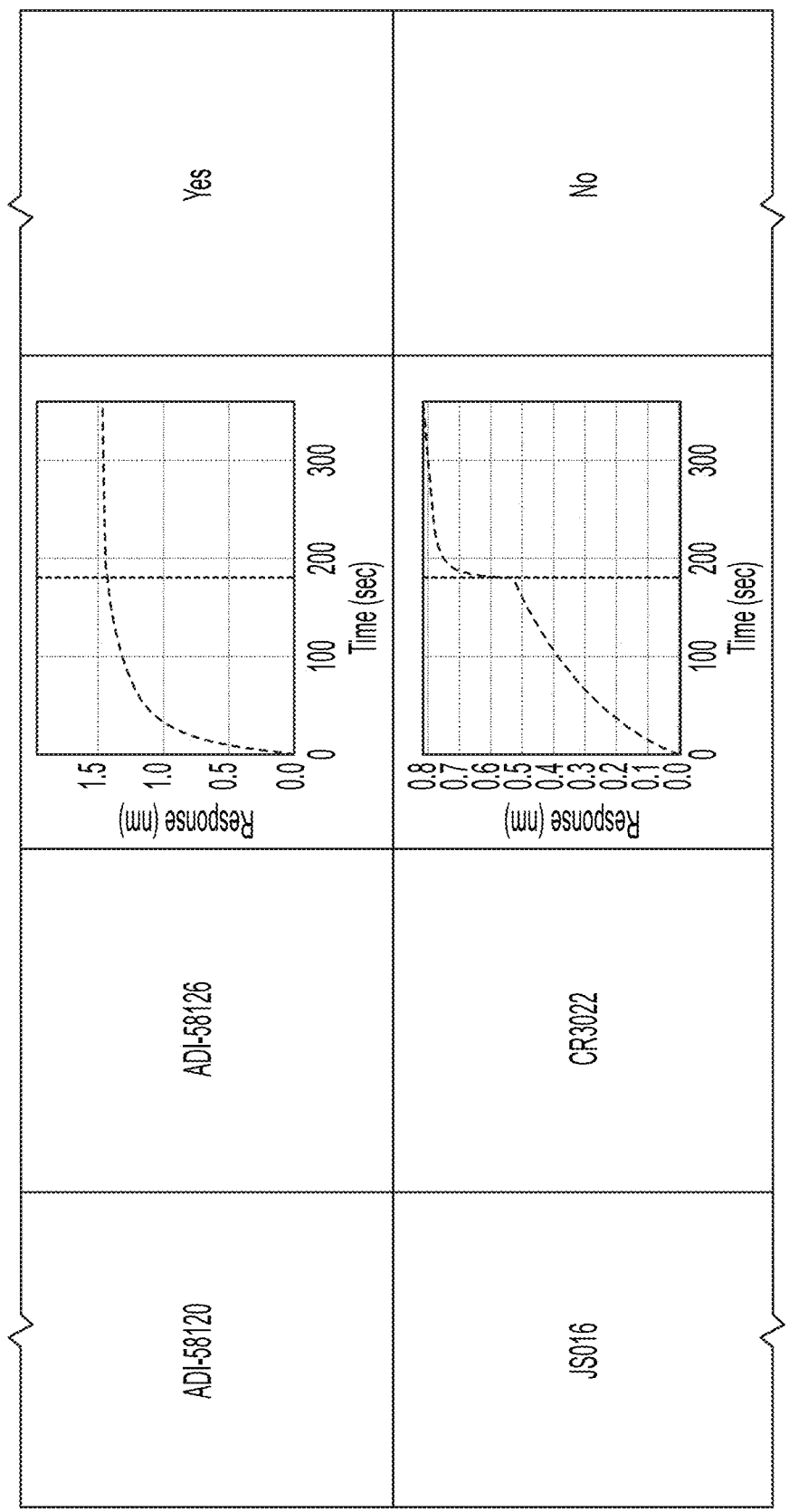
Figure 42F:
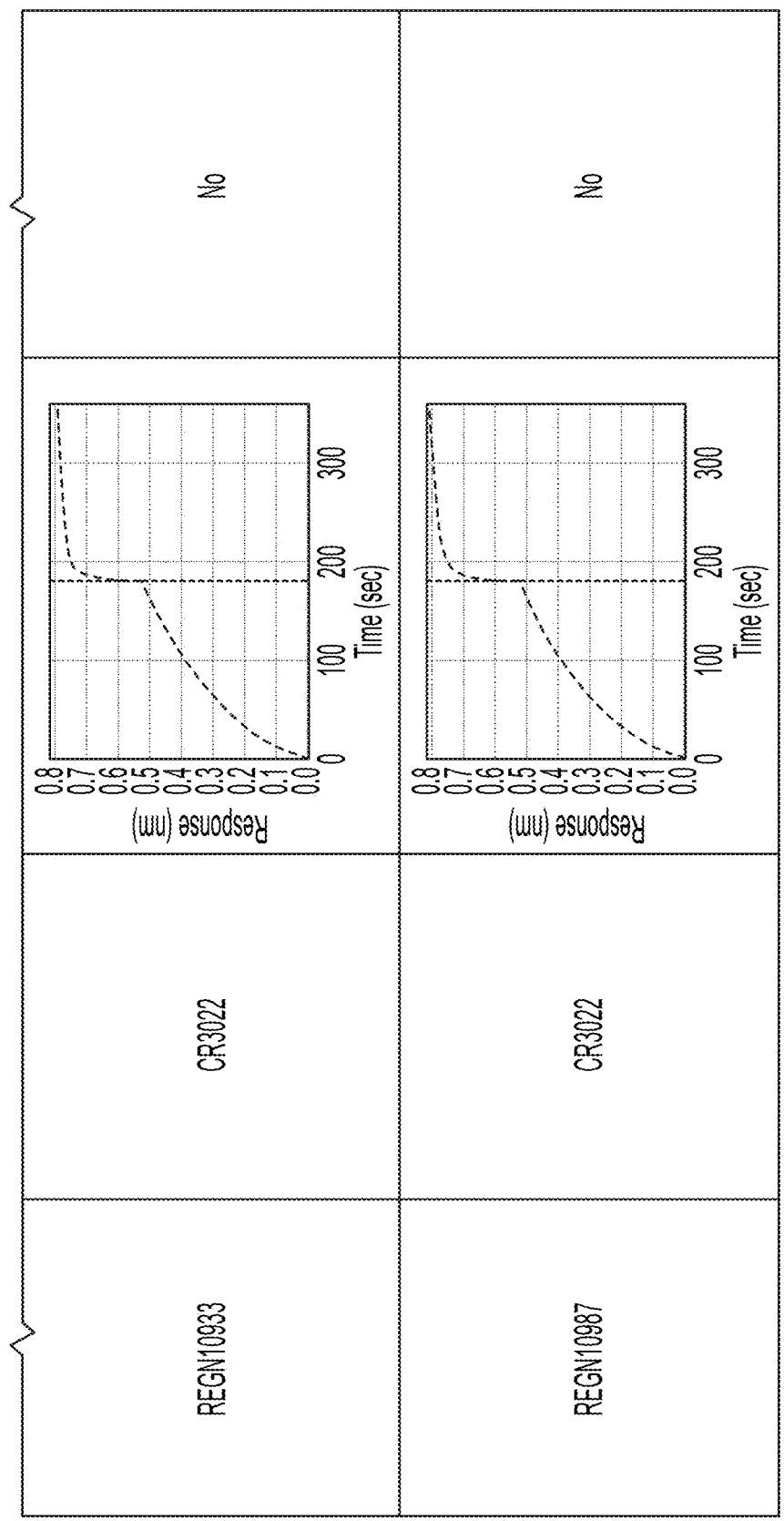
Figure 42G:
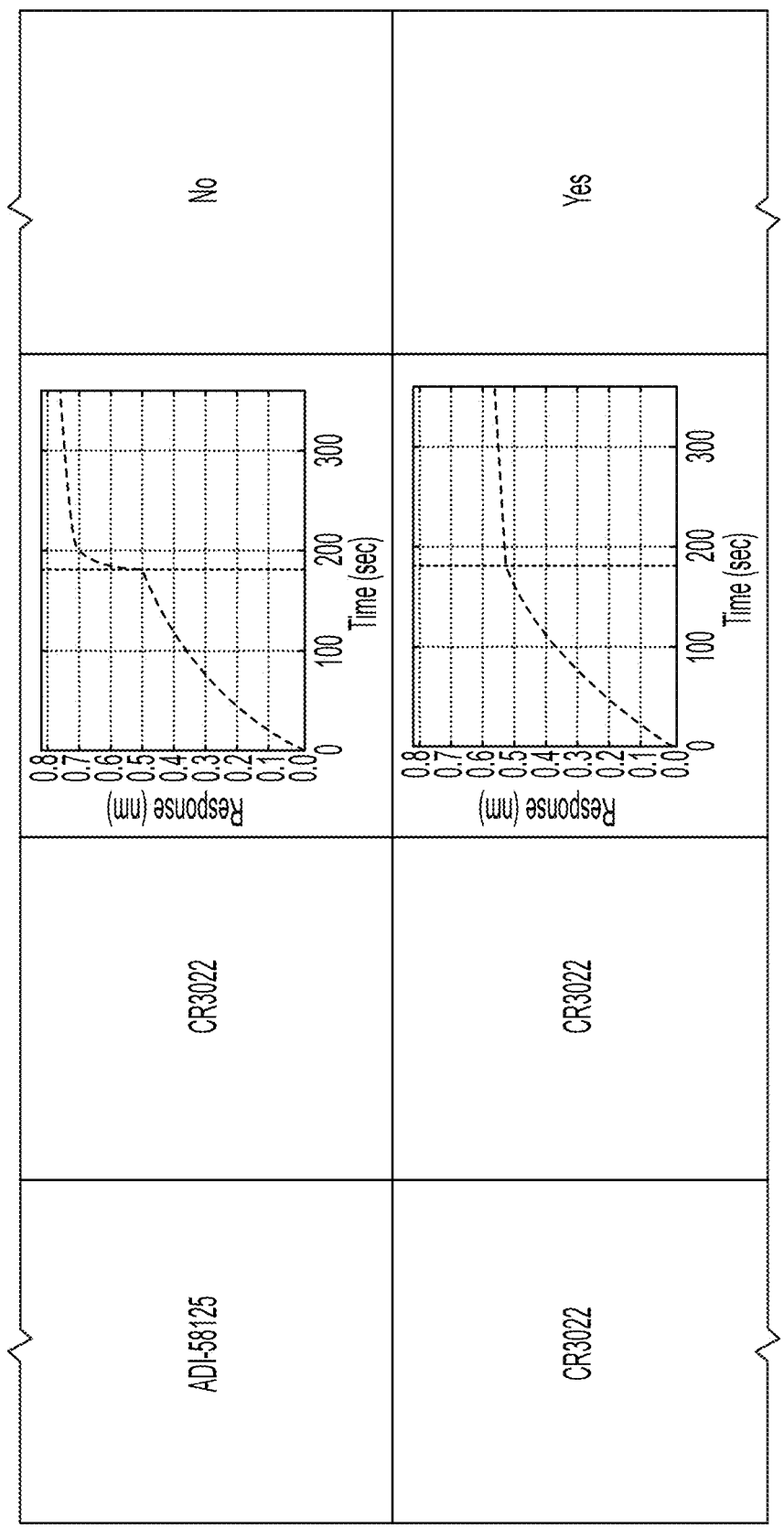
Figure 42G:
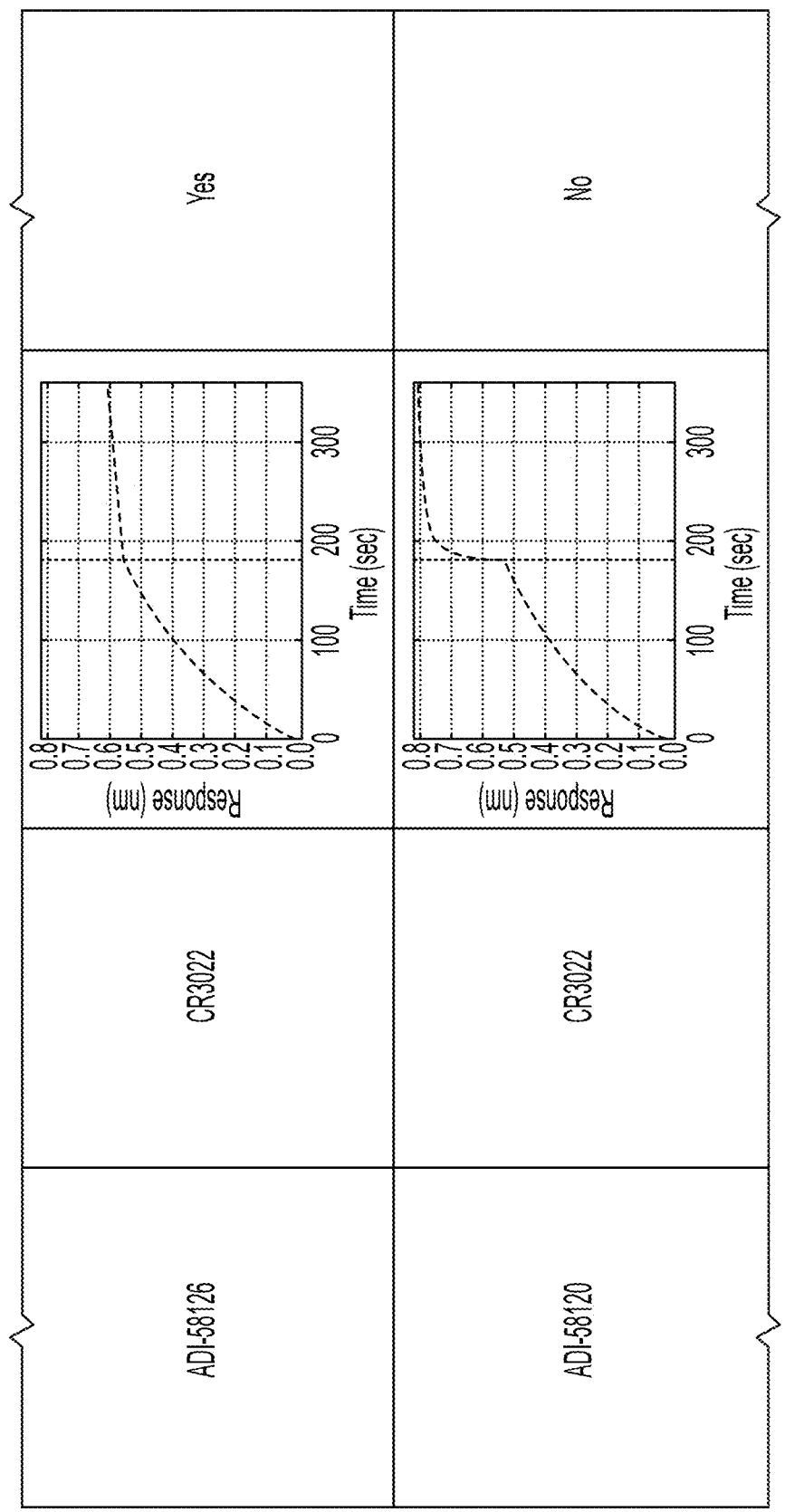
Figure 42G:
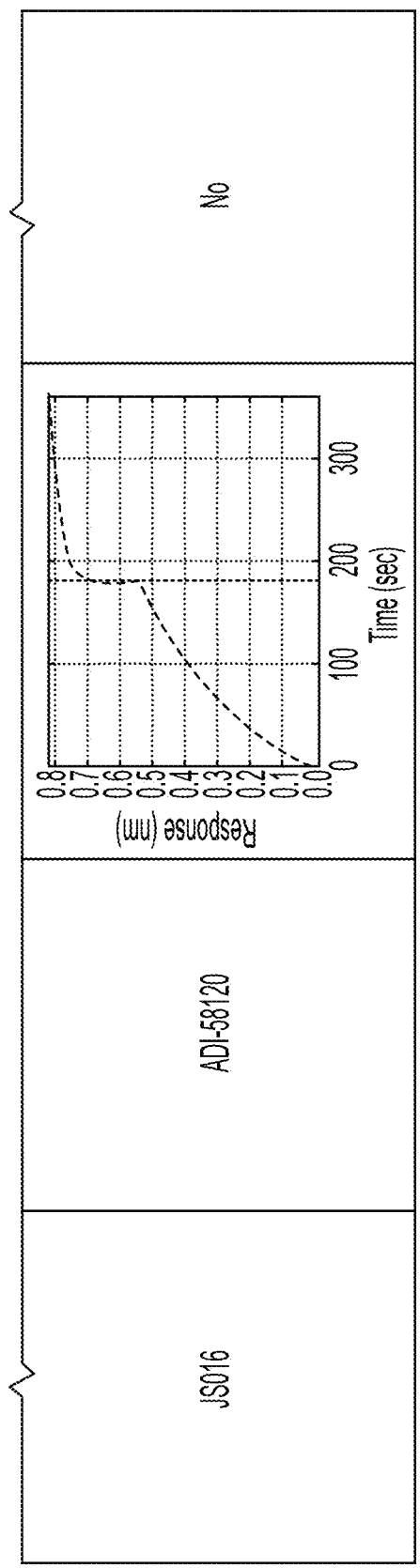
Figure 42G:
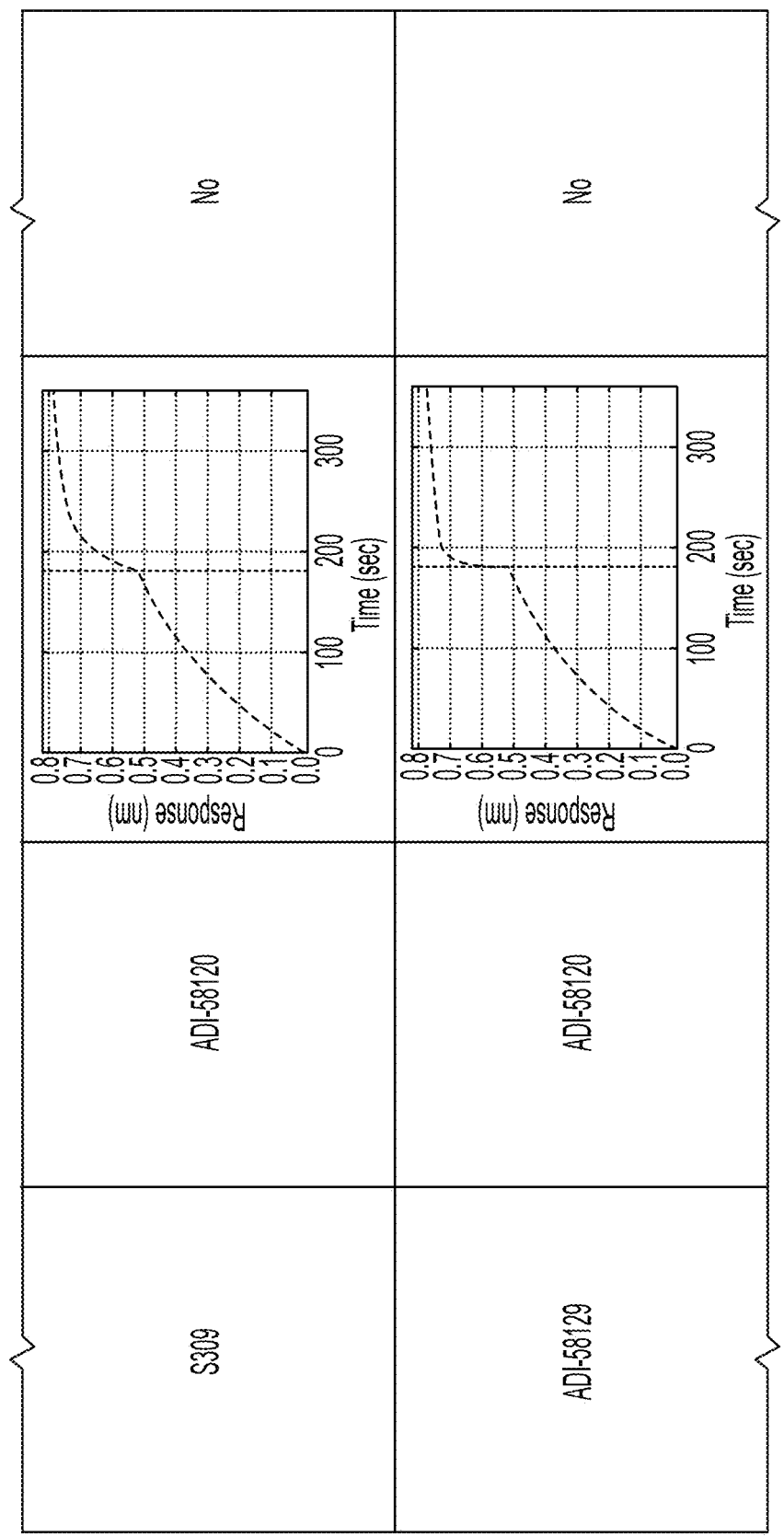
Figure 42G:
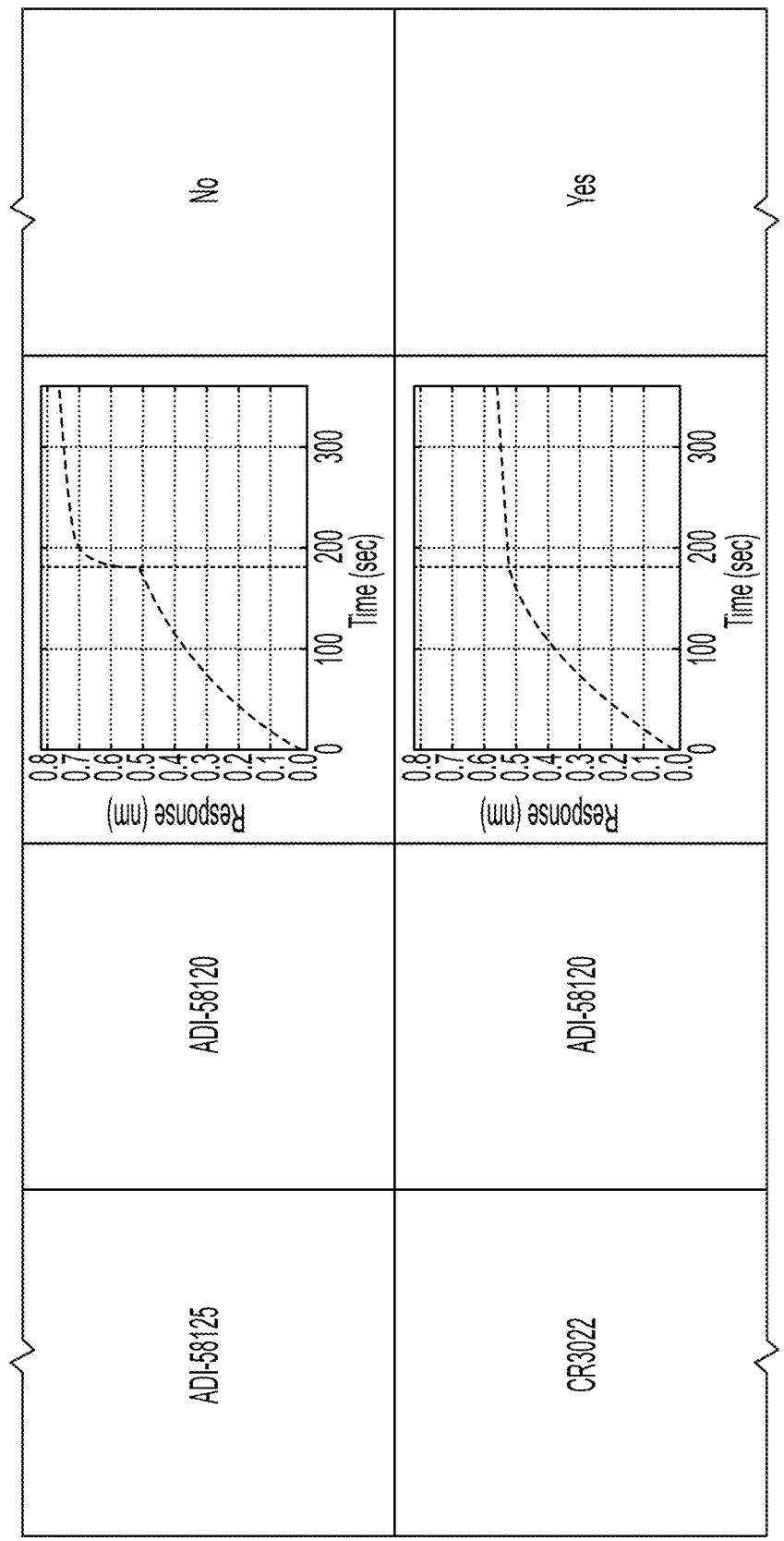
Figure 42G:
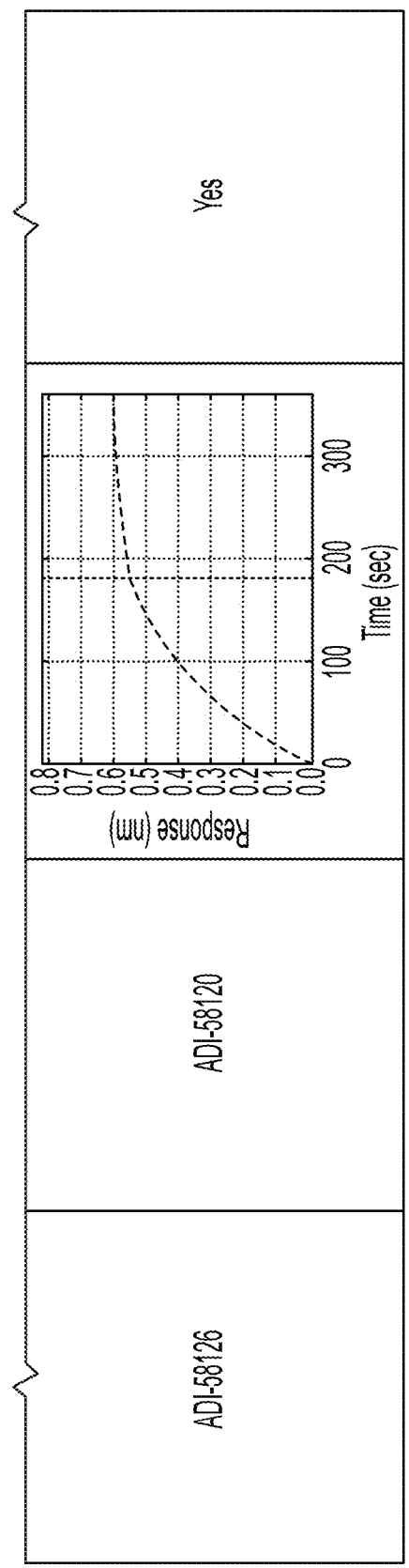

To further understand the epitope of the novel antibodies, competitive binding analyses were conducted using BLI. Competition between ACE2 and respective antibodies for binding to SARS-CoV-2-S was first analysed. As shown in FIGS. 42A-42B, ADI-58120, ADI-58121, ADI-58122, ADI-58123, ADI-58124, ADI-58125, ADI-58126, ADI-58127, ADI-58128, and ADI-58129 competed with ACE2, while ADI-58130 and ADI-58131 did not. All tested clinical antibodies except S309 competed with ACE2. Competition between two different antibodies were also analyzed. Results are shown in FIGS. 42C-42G.

Based on these results, competition between two antibodies and competition between hACE2 and an antibody are summarized in FIG. 4211. Table 4 provides the framework region mutations in VH and VL chain of the selected antibodies.

TABLE 4

| ADI ID | VH Non-Designed FR Mutations | VH Designed FR mutations | VL Non-Designed FR Mutations | VL Designed FR mutations |
|---|---|---|---|---|
| ADI-58120 | 5 | 0 | 4 | 0 |
| ADI-58121 | 5 | 0 | 4 | 0 |
| ADI-58122 | 5 | 0 | 4 | 0 |
| ADI-58123 | 5 | 0 | 4 | 0 |
| ADI-58124 | 2 | 0 | 1 | 0 |
| ADI-58125 | 2 | 0 | 1 | 0 |
| ADI-58126 | 3 | 0 | 0 | 0 |
| ADI-58127 | 3 | 0 | 0 | 0 |
| ADI-58128 | 2 | 0 | 0 | 0 |
| ADI-58129 | 2 | 0 | 0 | 0 |
| ADI-58130 | 0 | 0 | 0 | 0 |
| ADI-58131 | 0 | 0 | 0 | 0 |

Methods used for the competitive binding studies are provided below.

ACE2 Competitive Binding Studies:

Biosensor Instrument, Sensor Tip, Assay Buffer and Assay Conditions: BLI analysis was conducted at 25° C. in a PBSF buffer system using a ForteBio Octet HTX (Sartorius Bioanalytical Instruments, Bohemia, N.Y.) equipped with AHC sensor tips.

Reagent Preparation: The SARS-CoV-2 S and ACE2 proteins were prepared in bulk by dilution of the stock solution with PBSF buffer to a concentration of 100 nM.

Antibody Formulation: The antibodies were diluted from their stock concentrations to 100 nM.

Sensor Tip Preparation: The AHC sensor tips were soaked in PBSF buffer for 10 minutes and then exposed (~60 s) to wells containing the IgGs. The loaded sensors were then soaked in PBSF buffer for 15 min. Any remaining Fc capture sites on the sensor tip were blocked by exposing (10 min) the IgG loaded sensor tips with an irrelevant IgG (adalimumab, 0.5 mg/mL). These loaded and blocked sensor tips were soaked in PBSF buffer for 30 minutes before proceeding to the competitive binding experiment.

Experiment Steps: Each experiment cycle began with dipping (180 s) the sensor tip into PBSF buffer to establish a stable baseline. This was followed by exposure (180 s) of the IgG loaded sensor tip to wells containing ACE2. This step is necessary to show whether there is any interaction between the IgG and ACE2. After a short dip (60 s) into fresh wells of PBSF buffer, the sensor tip was dipped (180 s) into wells containing the SARS-CoV-2 S protein. The sensor tips were then immediately dipped (180 s) into wells containing ACE2 protein to monitor any association of ACE2 to antibody bound SARS-CoV-2 S protein.

Data Processing: The data was cropped to isolate the SARS-CoV-2 S and ACE2 exposure steps and then x and y-axis aligned using ForteBio Data Analysis software version 11.1.3.10.

Competitive Binding Experiments Using Biolayer-Interferometry:

Competition between antibodies for binding to soluble SARS-CoV-2 S protein was assessed using the ForteBio Octet HTX (Sartorius Bioanalytical Instruments). All reagents were diluted to 100 nM in PBSF. AHC sensor tips were loaded with ADI-58124 IgG, followed by exposure to an inert IgG to block any remaining Fc capture sites. Tips were subsequently equilibrated in PBSF for 30 min. ADI-58124-loaded sensor tips were transferred to wells containing hACE2, CR3022, or 5309 to check for any interaction with ADI-58124. Sensor tips were then loaded in wells containing fresh PBSF buffer (60 s), followed by exposure to SARS-CoV-2 S protein (180 s), and lastly, exposure to hACE2, CR3022, or 5309 (180 s). Data were cropped to include only SARS-CoV-2 S protein and hACE2, CR3022, or 5309 exposure steps and aligned by x- and y-axes using ForteBio Data Analysis software version 11.1.3.10.

Example 29: Fc-Mediated Effector Functions by Post-Affinity Maturation Antibodies ADI-58125 and ADI-58124 share the same CDR sequences and only differ in the Fc region which has been engineered for half-life extension purpose. Because Fc-mediated effector functions can contribute to protection independently of viral neutralization, ADI-58124 and ADI-58125 binding to different Fc gamma receptors (FcgRs), neonatal Fc receptor (FcRn), and the complement component C1q was tested. Results are shown in FIGS. 43A-43C.

FIG. 43A shows that there is no significant difference in binding of any of these tested FcgR proteins to ADI-58124 and ADI-58125. This indicates suggesting that the Fc half-life extension LA mutations in ADI-58124 do not affect binding to any of the FcgR proteins assessed in the studies here. Functionally, this implies that ADI-58125 will possess normal effector functions mediated through interaction with FcgR, which may contribute to ADI-58125 SARS-CoV-2 neutralizing activity.

FIG. 43B shows that at pH 6.0, the ADI-58124 and ADI-58125 Fc variants provide slightly different binding profiles to human and cyno FcRn. In general, each IgG binds to cyno FcRn slightly stronger than to human FcRn. For both human and cyno FcRn, ADI-58125 (LA Fc) bound with higher affinity than ADI-58124 (WT Fc) at pH 6.0. The enhanced affinity of ADI-58125 to FcRn at pH 6.0 is expected to translate to extended in vivo half-life. Neither ADI-58124 nor ADI-58125 bound to FcRn at pH 7.4.

FIG. 43C shows that ADI-58124 and ADI-58125 have equivalent affinities to C1q and, therefore, the LA mutations in ADI-58125 are not expected to impact IgG1 Fc-mediated complement pathway activation.

Methods used to assess Fc binding are provided below.

FcgR Binding Studies:

Biosensor Instrument, Sensor Chip, Running Buffer and Assay Conditions: SPR analysis was conducted at 25° C. in a HBS-EP+ buffer system (10 mM HEPES, pH 7.4, 150 mM NaCl, 3 mM EDTA, 0.05% Surfactant P20) using a Biacore 8K optical biosensor equipped with a CAP sensor chip (Global Life Sciences Solutions USA, Marlborough, Mass.). (Global Life Sciences Solutions USA, Marlborough, Mass.). The sample compartment was maintained at 10° C. for the duration of the experiment. This assay orientation allows for reproducible capture of biotinylated samples to the sensor surface.

Surface Preparation: Prior to each analysis the sensor chip surface was first conditioned with 3 pulses (60 s at 10 µL/min) of regeneration solution (6 M Guanidine-HCl in 0.25 M NaOH).

Antigen Preparation: SARS-CoV-1 RBD was prepared in bulk by dilution of the stock samples with HBS-EP+ buffer at a test concentration of 6.0 nM.

ADI-58124 and ADI-58125 Formulation: Both antibodies were diluted from their stock concentrations to a concentration of 27.0 nM.

FcgR Formulation: The FcgRI protein was diluted from its stock concentration to 32 nM and then serially diluted (2-fold) to a concentration of 1.0 nM. All other FcgR proteins were diluted from their stock concentrations to 1024 nM and then serially diluted (2-fold) to a concentration of 8.0 nM Experiment Steps: Each experiment cycle began with an injection (300 s at 2 µuL/min) over flow cells 1 and 2 of a 1:20 solution of biotin CAPture reagent (Global Life Sciences Solutions USA, lot #10275955) in HBS-EP+ buffer. This was followed by an injection (180 s at 10 µL/min) of the biotinylated antigen overflow cell 2. Upon capture of the antigen to the sensor surface, ADI-58124 or ADI-58125 was injected (180 s at 30 µl/min) overflow cells 1 and 2. The dissociation of the IgG was monitored for 120 s prior to injection (180 s) of the FcgR. Dissociation of the FcgR from the sensor surface was monitored for 180 s. Finally, an injection (120 s at 10 µL/min) of regeneration solution overflow cells 1 and 2 prepares the sensor surface for another cycle.

Model/Fit: The data was first cropped to include only the steps that involve the FcgR association and dissociation.

This selected data was then aligned, double reference subtracted, and then non-linear least squares fit to a 1:1 binding model using Biacore Insight Evaluation software version 3.0.11.15423.

FcRn Binding Studies:

Biosensor Instrument, Sensor Chip, Running Buffer and Assay Conditions: SPR analysis was conducted at 25° C. using a Biacore 8K optical biosensor equipped with either a CM3 or CM5 sensor chip (Global Life Sciences Solutions USA, Marlborough, Mass.). The sample compartment was maintained at 10° C. for the duration of the experiment.

Instrument Running Buffer: These studies were conducted in an HBS-EP+ buffer system (10 mM HEPES, 150 mM NaCl, 3 mM EDTA, 0.05% Surfactant PS20) at pH 6.0 or pH 7.4.

Antibody Formulation: A pH scouting study helped determine the buffer pH and approximate concentration for direct immobilization of each IgG to the sensor surface.

Surface Preparation: The sensor surface was prepared as follows: a 1:1 mixture of EDC and NHS was injected (420 s) over flow cells 1 and 2, the antibody was injected (120 s) over flow cell 2 and finally ethanolamine was injected (420 s) over flow cells 1 and 2.

FcRn Formulation: For the experiments performed at a buffer pH of 6.0, human and cyno FcRn were diluted from their stock concentrations with HBS-EP+ buffer (pH 6.0) to a concentration of 60.0 nM and serially diluted (2-fold) to 0.029 nM. For the experiments performed at a buffer pH of 7.4, human and cyno FcRn were diluted from their stock concentrations with HBS-EP+ buffer (pH 7.4) to a concentration of 128 nM and serially diluted (2-fold) to 1.0 nM.

Experiment Steps: Each experiment cycle began with an injection (180 s at 30 µuL/min) of FcRn over flow cells 1 and 2. The dissociation of the FcRn was observed for 180-300 s before the sensor surface was regenerated via two injections (20 s at 30 µuL/min) of HBS-EP+ buffer (pH 7.4) which prepares the sensor surface for another cycle.

Model/Fit: The data was aligned, double reference subtracted, and then non-linear least squares fit to a 1:1 binding model using Biacore Insight Evaluation software version 3.0.11.15423.

C1q Binding Studies:

Biosensor Instrument, Sensor Tip, Assay Buffer and Assay Conditions: BLI analysis was conducted at 25° C. in a PBSF buffer using a ForteBio Octet HTX (Sartorius Bioanalytical Instruments, Bohemia, N.Y.) equipped with SA sensor tips. These assay conditions were adapted from Zhou et al. (2)

Antigen Preparation: Biotinylated SARS-CoV RBD was prepared in bulk by dilution of the stock sample with PBSF buffer to a loading concentration of 100 nM.

Sensor Tip Preparation: The sensor tips were soaked in PBSF buffer for 10 minutes and then exposed (300 s) to wells containing biotinylated SARS-CoV RBD. Following an additional 20 minute incubation in PBSF, the antigen loaded sensors were exposed (90 s) to wells containing the IgG.

Antibody Formulation: ADI-58124 and ADI-58125 were diluted from their stock concentrations to 100 nM.

C1q formulation: The stock solution of C1q was diluted into PBSF buffer to 10 nM and then serially diluted (2-fold) to a concentration of 0.625 nM.

Experiment Steps: Each experiment cycle began with dipping (60 s) the sensor tips into PBSF to establish a stable baseline. The sensor tips were then dipped (180 s) into wells containing C1q or blank buffer. The sensor tips were then immediately dipped (180 s) into fresh wells containing PBSF buffer to monitor (initial 30 s) the dissociation of C1q from the sensor tip surface.

Model/Fit: The data was x and y-axis aligned and then non-linear least squares fit to a 1:1 binding model using ForteBio Data Analysis software version 11.1.3.10.

Figure 43D:
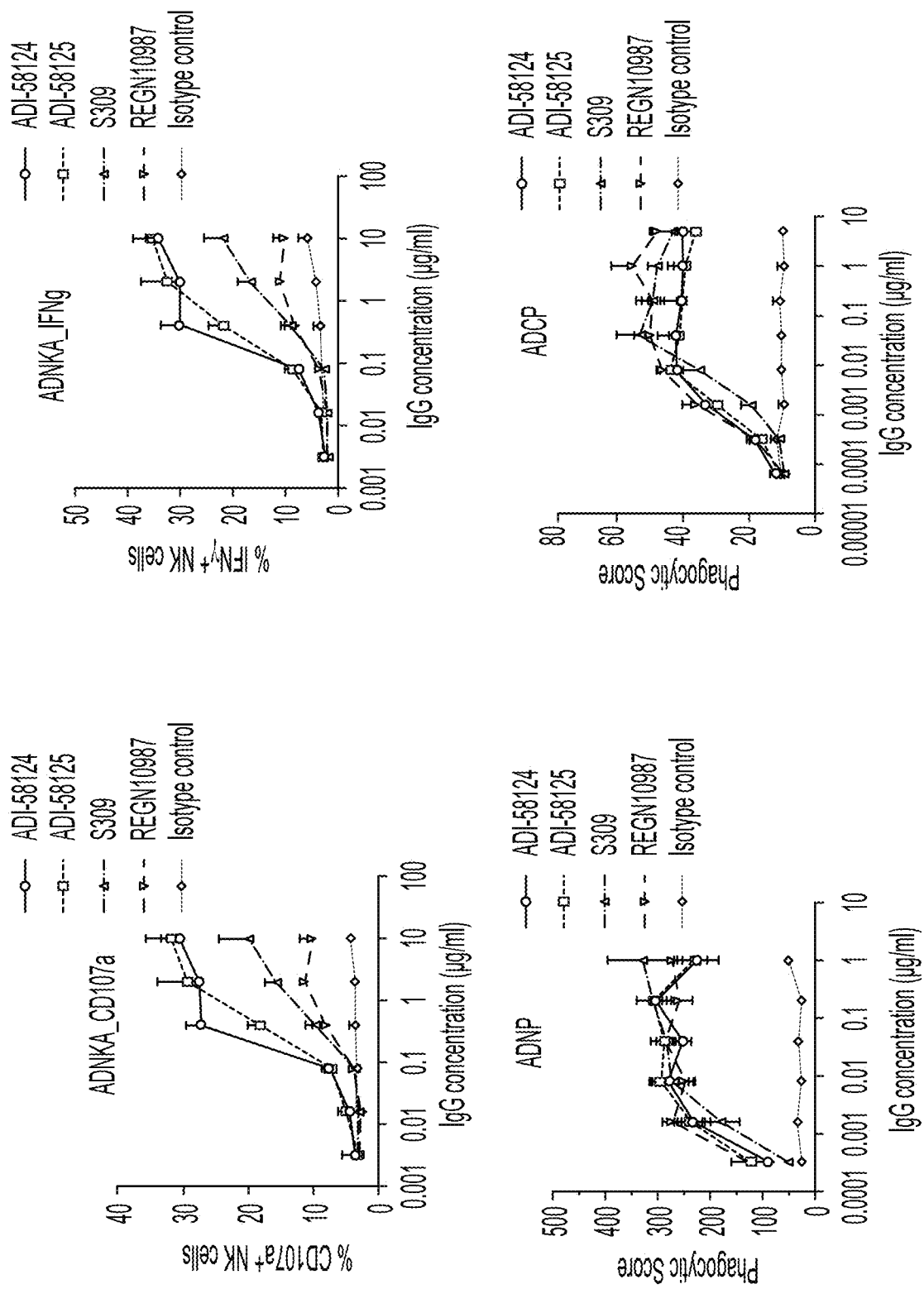
FIGS. 43D-43E demonstrates that ADI-58124 and ADI-58125 trigger Fc-mediated effector functions. The indicated antibodies were assessed for the ability to induce Fc-mediated effector functions against RBD-coated targets at varying concentrations.
Figure 43D:
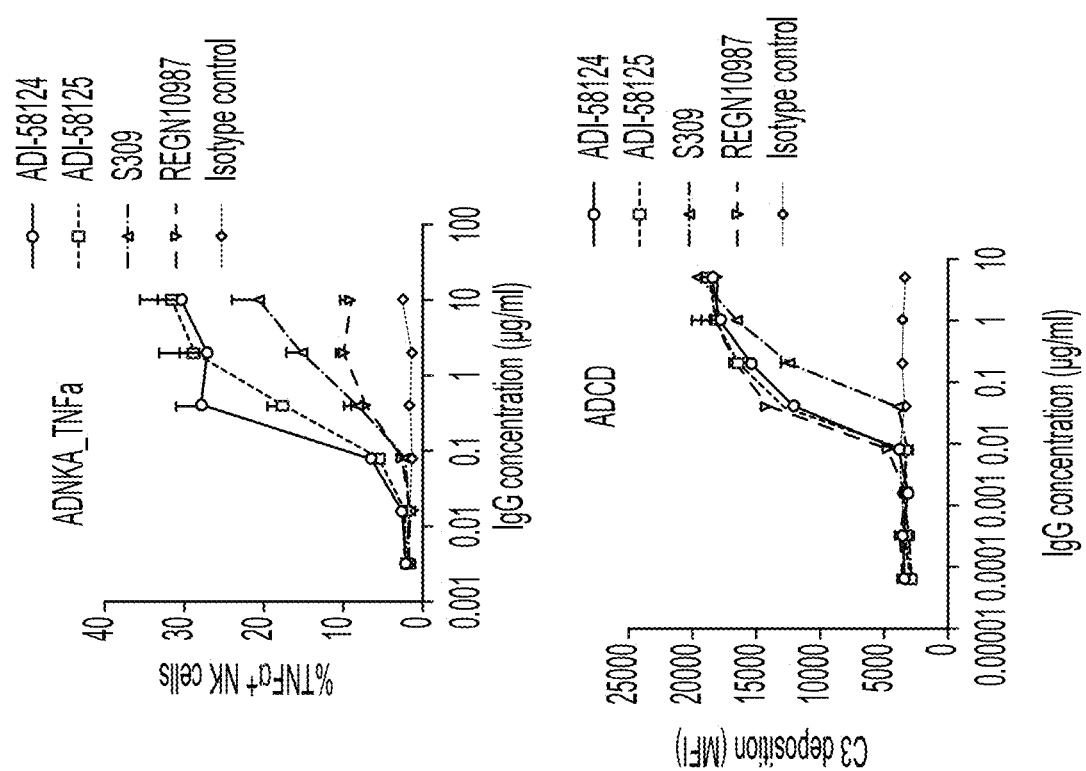
Figure 43E:
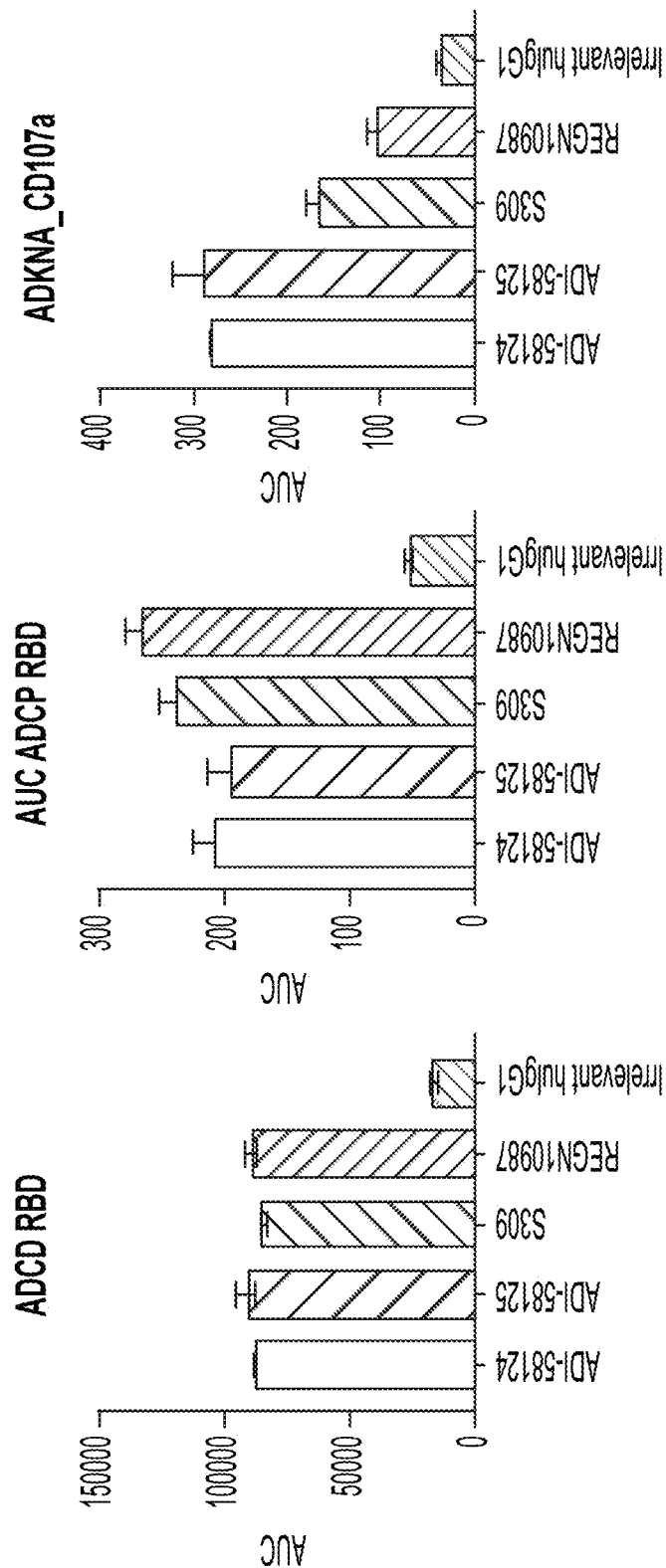

Subsequently, the ability of ADI-58124 and ADI-58125 to induce antibody-dependent natural killer cell activation and degranulation (ADNKDA), antibody-dependent cell phagocytosis mediated by monocytes and neutrophils (ADCP and ADNP), and antibody-mediated complement deposition (ADCD) was assessed using previously described in vitro assays (B. M. Gunn et al., *Cell Host Microbe* 24, 221-233 (2018)). Clinical SARS-CoV-2 nAbs S309 and REGN10987 were also included as comparators. ADI-58124 and ADI-58125 displayed a highly polyfunctional profile, resulting in the induction of phagocytosis by monocytes and neutrophils, deposition of the complement component C3, and induction of NK cell degranulation (a surrogate marker of ADCC) and activation (FIGS. 43D-43E). Interestingly, while ADI-58124, ADI-58125, S309, and REGN10957 showed comparable recruitment of phagocytosis, these antibodies differed with respect to complement deposition and NK cell activation; S309 showed reduced complement deposition compared with ADI-58124, ADI-58125, and REGN10987, and ADI-58124 and ADI-58125 showed superior NK cell activation over both S309 and REGN10987 (FIGS. 43D-43E). In summary, ADI-58124 and ADI-58125 robustly triggers diverse Fc-mediated effector activities with potencies comparable to or superior than that of current lead SARS-CoV-2 clinical antibodies.

Methods used in this example are briefly described below.

Ab-Dependent Natural Killer Cell Activation and Degranulation (ADNKDA):

Primary human NK cells were enriched from the peripheral blood of human donors using Rosette Sep Human NK cell Enrichment Cocktail (Stem Cell Technologies, Cat #15065) and cultured overnight in RPMI-1640 (Corning, Cat #15-040-CV) supplemented with 10% FBS (Hyclone SH30071.03), 1% Pen/Strep (Gibco, Cat #15070-063), 1% L-Glutamine (Corning Cat #25-005-CI), 1% HEPES (Corning, Cat #25-060-CI) and 5 ng/ml of recombinant human IL-15 (StemCell Technologies Cat #78031). Recombinant SARS-CoV-2 receptor binding domain was coated onto MaxiSorp 96-well plates (Thermo Scientific, Cat #442404) at 200 ng/well at 4° C. overnight. Wells were washed with PBS and blocked with 5% BSA prior to addition of antibodies that were diluted in a five-fold dilution series in PBS (10 µg/ml-0.32 ng/ml) and incubation for 2 h at 37° C. Unbound antibodies were removed by washing with PBS were added at $5\times10^4$ cells/well in the presence of 4 µg/ml brefeldin A (Biolegend, Cat #420601), 5 µg/ml GolgiStop (BD Biosciences Cat #554724) and anti-CD107a antibody (Clone H4A3 PE-Cy7, Biolegend Cat #328618) for 5 hours. Cells were stained for surface expression of CD16 (Clone 3G8 Pacific Blue, Biolegend Cat #302032), CD56 (clone 5.1H11 AlexaFluor488 Biolegend, Cat #362518) and CD3 (clone UCHT1 Alexa Fluor700, Biolegend cat #300424). Cells were fixed and permeabilized with Fix/Perm (Biolegend Cat #421002) according to the manufacturer's instructions to stain for intracellular IFNγ (Clone B27 PE, Biolegend Cat #506507), and TNFα (clone Mab11 APC, Biolegend Cat #502912). Cells were analyzed on a Cytek Aurora spectral flow cytometer.

Ab-Dependent Cell Phagocytosis with Monocytes and Neutrophils (ADCP and ADNP):

ADNP: HL-60 promyeloblast cells (ATCC Cat #CCL-240 were maintained in Iscove's Modified Dulbecco's Medium (ATCC Cat #30-2005) with 20% fetal bovine serum and 1% Pen/Strep. HL-60 cells were differentiated into neutrophils by growth for 5 days in the presence of 1.3% DMSO. Recombinant SARS-CoV-2 receptor binding domain was coupled to fluorescent beads (Thermo Scientific Cat #F8819) by carbodiimide coupling. Antibodies were diluted in a five-fold dilution curve in HL-60 culture medium (1 µg/ml-0.32 ng/ml) and incubated with RBD-coated beads for 2 h at 37° C. ($5 \times 10^4$ cells/well) were incubated for 18h at 37° C. Cells were then stained for CD11b (Clone M1/70 APC-Fire750; Biolegend Cat #101262) and CD16 (Clone 3G8 Pacific Blue, Biolegend Cat #302032) and fixed with 4% paraformaldehyde, and analyzed by flow cytometry. $CD11b^+$ and $CD16^+$ cells were analyzed for uptake of fluorescent beads. A phagocytic score was determined using the following formula: (percentage of $FITC^+$ cells)×(geometric mean fluorescent intensity (gMFI) of the FITC+ cells)/100,000.

ADCP: THP-1 monocytes were maintained in RPMI-1640 supplemented with 10% FBS, 1% Pen/Strep, 1% L-glutamine, and b-mercaptoethanol. Recombinant SARS-CoV-2 RBD-coated beads were generated as described for ADNP. Antibodies were diluted in a five-fold dilution curve in THP-1 culture medium to (5 µg/ml-64 pg/ml) and incubated with RBD-coated beads for 2 h at 37° C. Unbound antibodies were removed by centrifugation prior to the addition of THP-1 cells at $2.5 \times 10^4$ cells/well. Cells were fixed with 4% paraformaldehyde and analyzed by flow cytometry. A phagocytic score was determined as described above.

Ab-Mediated Complement Deposition (ADCD):

Recombinant SARS-CoV-2 receptor binding domain-coated beads were generated as described for ADNP. Antibodies were diluted in a five-fold dilution series in RPMI-1640 (5 µg/ml-64 pg/ml) 5 µg/ml and incubated with RBD-coated beads for 2 hours at 37° C. Unbound antibodies were removed by centrifugation prior to the addition of reconstituted guinea pig complement (Cedarlane Labs Cat #CL4051) diluted in veronal buffer supplemented with calcium and magnesium (Boston Bioproducts Cat #IBB-300) for 20 minutes at 37° C. Beads were washed with PBS containing 15 mM EDTA, and stained with an FITC-conjugated anti-guinea pig C3 antibody (MP Biomedicals Cat #855385). C3 deposition onto beads was analyzed by flow cytometry. The gMFI of FITC of all beads was measured.

Figure 43F:
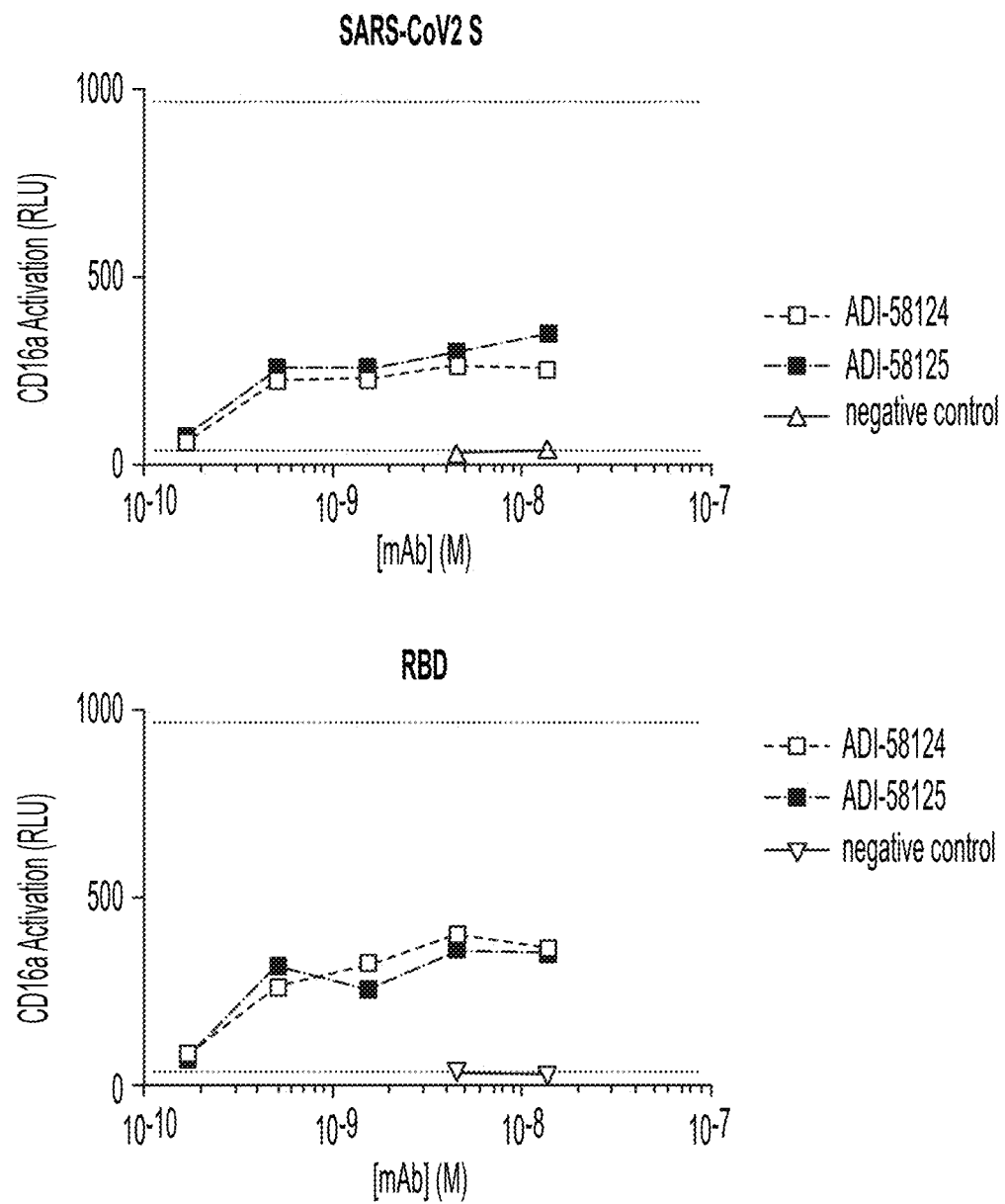
FIG. 43F provides comparison of ADI-58124 and ADI-58125 in the ability to induce ADCC. In the top panel, SARS-CoV-2 S-coated plates were used to evaluate ADI-58124 and ADI-58125 and negative control antibody to assess CD16A activation of Jurkat-Luria cells. The lower dotted line represents the baseline signal of cells and media online (no antibody). The upper dotted line represents positive control signal from a cell stimulation cocktail plus ionomycin. In the bottom panel, SARS-CoV2 RBD-coated plates used in the ADCC assay.

ADI-58124 and ADI-58125 were compared for the ability to induce antibody dependent cellular cytotoxicity, as measured by CD16a activation. As shown in FIG. 43F, which provides CD16a activation upon binding to SARS-CoV-2 S protein (top) or SARS-CoV-2 S protein RBD (bottom), both ADI-58124 and ADI-58125 demonstrated comparable ADCC activity. The results also indicate that CD16 activation is driven by engagement of the RBD.

Based on the results in FIGS. 43A-43E, the M428L/N434A modification in the Fc region to extend half-life of ADI-58125 did not alter Fc effector functions of the wild-type Fc-containing ADI-58124 antibody. Moreover, ADI-58125 exhibits multiple Fc effector activities, which may be critical for the clearance and control of SARS-CoV-2 infection.

A brief description of the method used to assess ADCC are provided below.

ADCC Activity Evaluation:

The ADCC assay assessed the activation of Jurkat-Lucia effector cells (Invivogen, jktl-nfat-cd16) via antibody cross-linking to antigen coated on high-binding 96 well plates (Corning, catalog #3361). The Jurkat-Lucia cells have stable expression of the cell surface Fc receptor CD16A (FcgRIIIA; V158 high affinity allotype). The Jurkat-Lucia cells also stably express the Lucia luciferase reporter gene under the control of an ISG54 minimal promoter fused to six NFAT response elements. Jurkat-Lucia binding to Fc of antibody-antigen complexes activates CD16A leading to luciferase expression.

SARS-CoV-2 S protein (Hexapro S-2P as described in (Hsieh, C. L., et al., (2020). Structure-based Design of Prefusion-stabilized SARS-CoV-2 Spikes. bioRxiv. doi: 10.1101/2020.05.30.125484) or RBD (Wrapp, D. et al., (2020). *Science*, 367(6483), 1260-1263. doi:10.1126/science.abb2507) was coated on plates the day before beginning the assay. The day of the assay, the coated plate was blocked and antibody dilutions (5 concentrations, 1:3 dilutions, from 2000 ng/mL to 25 ng/mL) were added to the plate with controls. Next Jurkat-Lucia cells were added at $1 \times 10^5$ cells/well, and plates were incubated at 37° C. with 5% CO2. Samples were assayed 24 hours later for luciferase activity by mixing assay supernatant with QUANTI-Luc luciferase substrate (Invivogen, rep-glc1). Luminescence was measured using a SpectraMax Paradigm, Molecular Devices.

Example 30: In Vivo Effects by Post-Affinity Maturation Antibodies

Figure 44A:
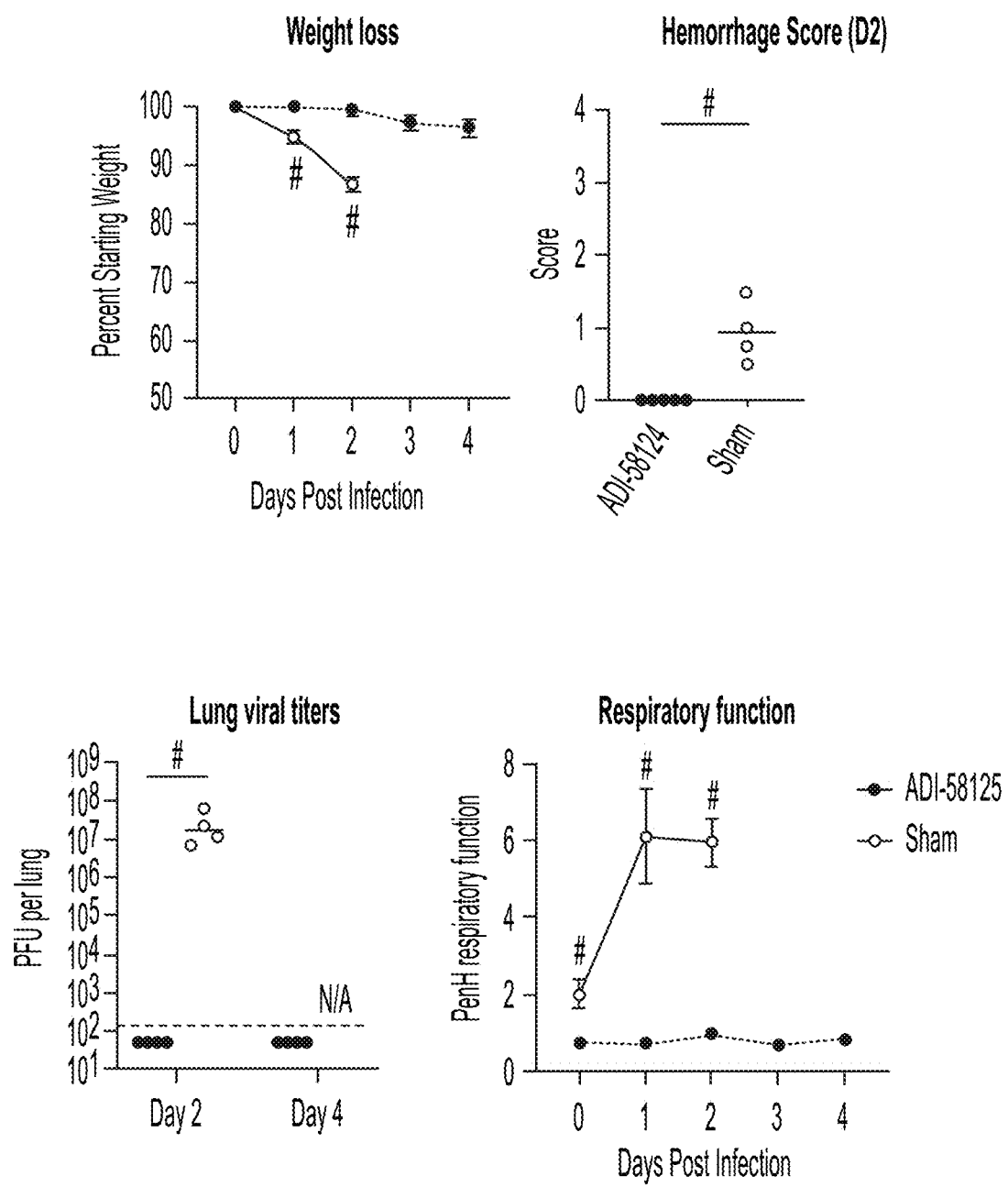
FIGS. 44A-44D demonstrate that ADI-58125 protects mice from SARS-CoV- and SARS-CoV-2-associated viral diseases, as evaluated in Example 30.
Figure 44B:
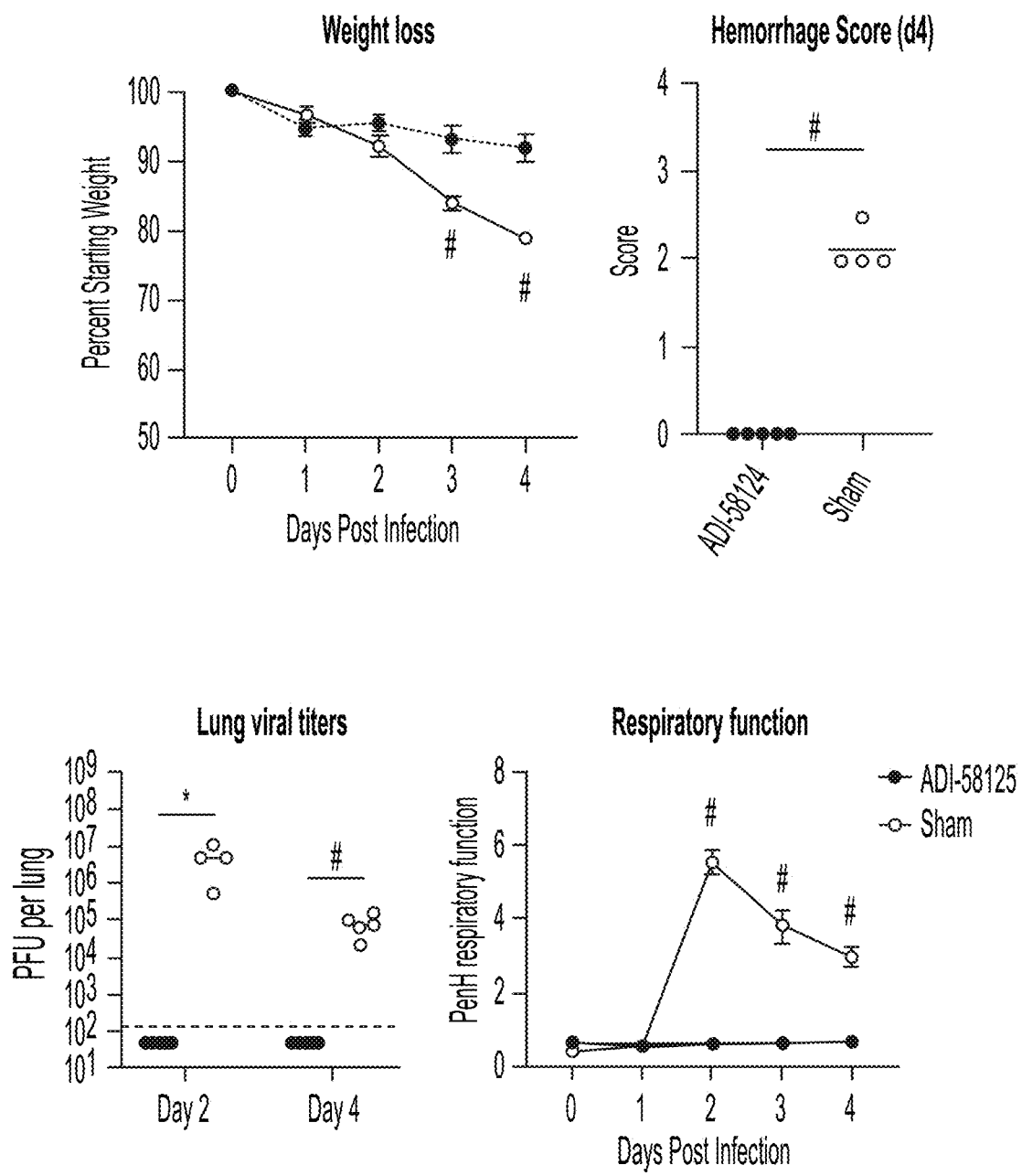
Figure 44C:
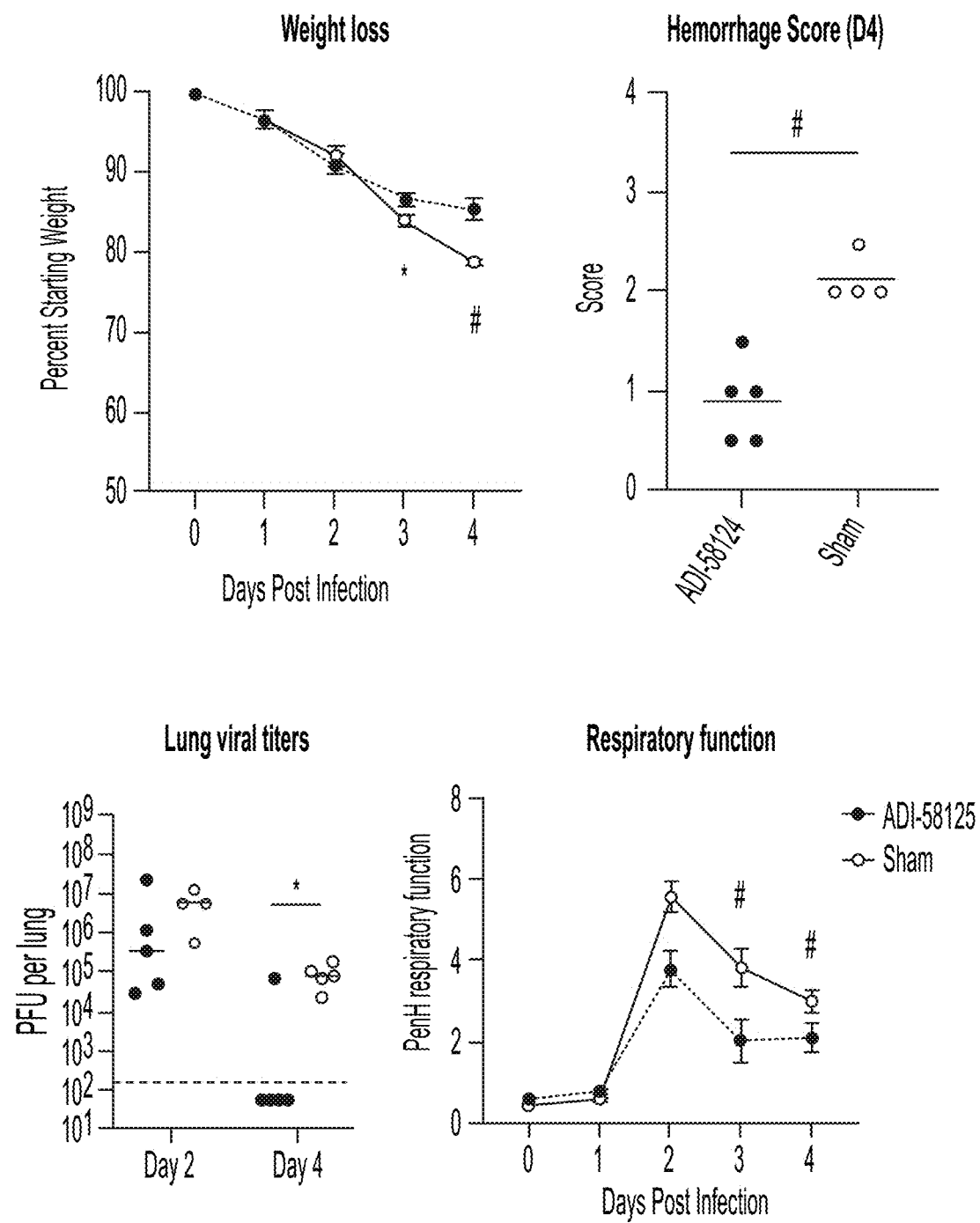

We tested the ability of ADI-58125 to provide broad in vivo protection in an immunocompetent mouse model of COVID-19 using mouse-adapted SARS-CoV (MA15) and mouse adapted SARS-CoV-2 (MA10) (A. Roberts et al., *PLoS Pathog* 3, e5 (2007); S. R. Leist et al. Cell, (2020)). Balb/c mice were prophylactically treated with either 200 µg of ADI-58125 or PBS via IP injection 12 hours prior to intranasal challenge with a $10^3$ PFU dose of MA15 or MA10. All mice were monitored daily for weight loss and changes in respiratory function and groups of mice were euthanized at day two or four post-infection to allow for measurement of virus replication in the lung and analysis of lung histopathology. Substantial, progressive weight loss in sham-treated mice infected with both viruses along with increases in Penh, a calculated measure of airway resistance (Leist S. R et al., A Mouse-Adapted SARS-CoV-2 Induces Acute Lung Injury and Mortality in Standard Laboratory Mice. *Cell* (2020)) was observed. In contrast, mice treated prophylactically with ADI-58125 demonstrated minimal weight loss, no change in Penh and no signs of gross pathology at the time of harvest (FIGS. 44A and 44B). Furthermore, prophylactic antibody treatment prevented viral replication in the lungs at both two and four days post infection (dpi). Next, the ability of ADI-58125 to act antivirally against SARS-CoV-2 MA10 in a therapeutic setting was investigated. Mice were treated with 200 µg of ADI-58125 or PBS 12 hours following intranasal challenge with a $10^3$ PFU dose of MA10. Mice given therapeutic ADI-58125 had intermediate levels of weight loss, moderate respiratory function changes and some gross lung pathology; significantly more than prophylactically treated mice but significantly less than sham-treated mice (FIG. 44C). Therapeutic antibody treatment also resulted in a significant reduction in lung viral loads at four dpi, but not at two dpi, relative to sham-treated mice. In conclusion, ADI-58125 treatment can reduce disease burden in mice infected with both SARS-CoV MA15 and SARS-CoV-2 MA10.

Figure 44D:
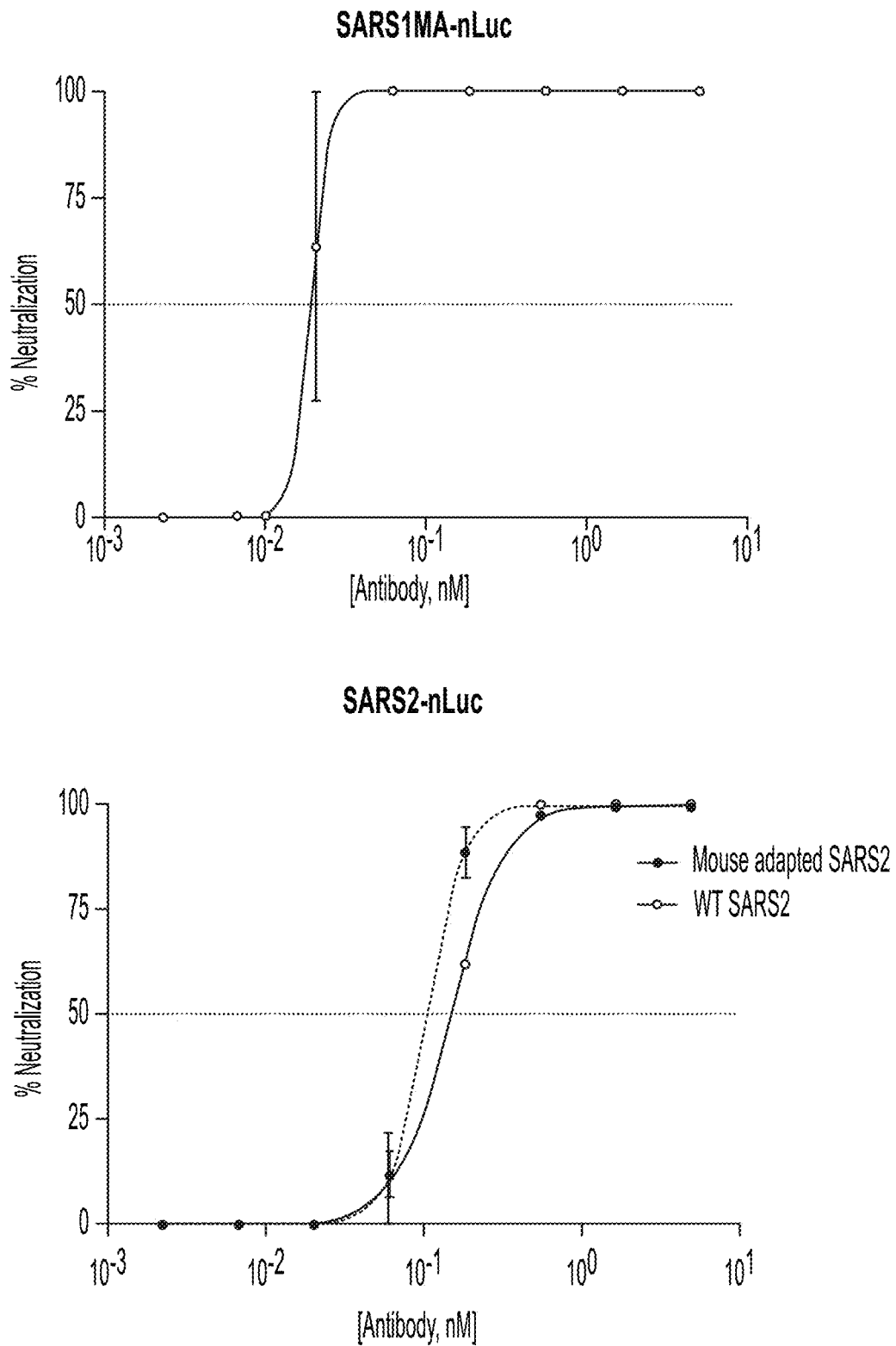

Neutralization of mouse adapted SARS-CoV and SARS-CoV-2 by ADI-58125 was confirmed as shown in FIG. 44D, via a luciferase-based assay using Vero E6 cells.

A brief description of the in vivo method used is provided below.

Animal Studies:

Twelve-month old female Balb/c mice (Envigo, strain 047) were treated with 200 μg of ADI-58125 IgG via intraperitoneal (IP) injection at either 12 hours prior to infection (prophylactic) or 12 hours post-infection (therapeutic). Mice were anesthetized with ketamine/xylazine before being challenged with 1000 PFU of either SARS-CoV-MA15 or SARS2-CoV-2-MA10 (34, 35) via intranasal inoculation. Mouse body weights and respiratory function were monitored daily for 4 days. Respiratory function was monitored by whole body plethysmography (DSI) with a 30-minute acclimation period and a 5-minute measurement window as previously described (51). Viral lung titer was measured by plaque assay, assessing the lower lobe of the right lung. Gross pathology was performed on mice sacrificed on day 2 and day 4 post-infection. Gross pathology in the lung scored using a 4-point system, in which 0 represents no hemorrhage and 4 represents complete and total hemorrhage. All animal husbandry and experiments were performed at BSL3 and in accordance with all University of North Carolina at Chapel Hill Institutional Animal Care and Use Committee guidelines (AAALAC Institutional Number 329).

Mouse Adapted Virus Neutralization:

ADI-58125 was diluted in growth media at 8 different concentration to obtain a potential inhibition curve. SARS1-MA-nLuc (75 PFU/well) and SARS2-MA2-nLuc (85 PFU/well) viruses were mixed with ADI-58125 at 1:1 and incubated. Virus and ADI-58125 mix were added to wells of plated Vero E6 cells and incubated. Luciferase activities were measured and percent inhibition, including IC50, was calculated by fitting the data points using a sigmoidal dose response curve.

Example 31: Potential ADE Effects

Studies on SARS-CoV and other respiratory viruses poses a question whether anti-SARS-CoV-2 antibodies could cause antibody-dependent enhancement (ADE), in which antibodies are taken up by immune cells via Fc receptors to result in increase virus proliferation and/or enhanced inflammation. To test the possibility of the antibodies according to the present disclosure and clinical antibodies specific to SARS-CoV-2 to induce ADE, uptake of pseudoviruses by phagocytes in the presence of the test antibodies were examined. As shown in FIGS. 45A-C, ADI-58124 and ADI-58125 did not mediate ADE of infection in both THP-1 and Raji cells.

The methods used in the ADE analyses are briefly provided below.

Reporter Viral Particle Production:

CoV2pp, VSV ΔG (rLuc) reporter virus particles, or RVPs, expressing SARS-CoV-2 S were provided by Dr. Benhur Lee (Icahn School of Medicine at Mount Sinai, New York City, N.Y.). Production and titration of SARS-COV-2 RVPs is described in (Oguntuyo K. Y. et al., Quantifying absolute neutralization titers against SARS-CoV-2 by a standardized virus neutralization assay allows for cross-cohort comparisons of COVID-19 sera. Version 2. medRxiv. Preprint. Aug. 15, 2020 [revised Aug. 27, 2020]). Briefly, 293T cells were transfected to overexpress SARS-COV-2 glycoproteins. After suitable incubation, post transfected cells were infected with the VSV-deltaG-rLuc reporter virus. Two days post infection, supernatants were collected. VSVdeltaG-rLuc particles bearing CoV2pp were processed and stored.

Antibody-Dependent Enhancement Assay:

Antibody-dependent enhancement assays were performed in Dr. Paul Guyre's lab at the Geisel School of Medicine, Dartmouth College, Lebanon, N.H. In vitro ADE was determined by assessing uptake of the RVPs into THP-1 (human monocyte derived cell line, ATCC TIB-202) or Raji cells (human B-cell derived cell line, ATCC CCL-86) in the presence of a range of antibody concentrations from above the IC50 to approximately 100-fold below the IC50. Antibody dilutions were prepared in an opaque white 96-well plate (BRAND plates, catalog number 781965) using serum-free, dye-free RPMI media (Gibco, 11835-030) as diluent. A series of test antibody concentrations starting at 100 ng/mL with 1:5 serial dilutions were prepared with final antibody concentrations of 100, 20, 4, 0.8, 0.16, and 0.032 ng/mL. A control antibody was tested at the highest concentration only (100 ng/mL).

The RVPs, CoV2pp, VSV ΔG (rLuc), were thawed at 37° C. for 3 min, then placed on ice prior to addition the antibody plates. 20 μL of RVP was added to each well. The RVPs and antibody mixes were incubated at 37° C., 5% CO2, for 1 hour. Then, Raji or THP-1 cells were added at a concentration of 2e5 cells/well, and plates were incubated for 18-24 hours at 37° C., 5% CO2.

To measure luciferase activity associated with RVP uptake, the *Renilla* Luciferase Assay kit was used (Promega, E2820). Lysis buffer and *renilla* luciferase assay reagent were prepared from the luciferase assay kit per manufacturer instructions. Plates were removed from the incubator and centrifuged for 5 min at 1200 rpm to pellet cells. Cells were washed with phosphate buffered saline (PBS, Corning, 21-040-CV), then cells were pelleted by centrifugation for 5 min at 1200 rpm and PBS was aspirated from all wells. Cells were lysed using 50 μL of 1× Lysis buffer, and plates were incubated for 15 min on a rocker. A SpectraMax i3x luminometer used to inject luciferase assay reagent (100 μL) to each well, followed by immediate measurement of luminescence. Data were plotted by histogram using GraphPad Prism 8.

Example 32: In Vivo Therapeutic and Prophylactic Efficacy of Antibody Combinations Therapeutic and/or Prophylactic Efficacy Test animals, preferably mammals such as mice, rats, hamster (e.g., Syrian hamsters), rabbits, pigs, or monkeys, will be split in multiple groups. ADI-57983, ADI-57978, ADI-56868, ADI-56443, and ADI-56479 or fragment thereof or a mixture of such IgGs and/or fragments thereof, especially antibodies that recognize different epitopes and/or do not compete with each other, e.g., "ADI-57983 and ADI-56443", will be administered to at least one group. At least one group will not receive such antibody or fragment thereof. The animals will then be infected with coronavirus (e.g., SARS-CoV, SARS-CoV-2 etc). Alternatively, the antibody or fragment thereof may be administered before the infection with CoV. The antibody or fragment thereof may be given intravenously, intraperitoneally, intranasally, subcutaneously, or via any other appropriate route.

The body weight of each animal will be monitored. Symptoms such as fever or mobility may also be monitored. Periodically, samples such as serum will be harvested and the viral load will be measured. Survival will be tracked. Animals may be sacrificed based on the pre-determined cutoff value of the body weight and/or viremia and/or the behavior and/or symptom(s).

Grouping that may be used for in vivo studies include, but is not limited to:

Group 1, negative control;

Group 2, ADI-58124 (or its Fc variant) only, ADI-58124 (or its Fc variant) only, or ADI-58126 (or its Fc variant) only (RBD-binding broad neutralizer);

Group 3, ADI-581230 (or its Fc variant) only (NTD binder);

Group 4, ADI-58124 (or its Fc variant)+ADI-581230 (or its Fc variant) (RBD-binding broad neutralizer+NTD binder);

Group 5, ADI-58128 (or its Fc variant) only (RBD binder, no competition with ADI-57983);

Group 6, ADI-58124 (or its Fc variant)+ADI-58128 (or its Fc variant) (RBD-binding broad neutralizer+non-competing RBD binder);

Group 7, ADI-58124 (or its Fc variant)+ADI-581230 (or its Fc variant) (NTD binder)+ADI-58128 (or its Fc variant) (RBD binder, no competition with ADI-57983).

Matching Fc will be used between Groups to allow for proper comparison.

A therapeutic or prophylactic dose of below 1 mg, for example 3 μg, may be administered.

Example 33: A Phase 2/3 Randomized, Double-Blind, Placebo-Controlled Clinical Trial to Evaluate the Efficacy and Safety of ADI-58125 in the Prevention of COVID-19

A phase 2/3 randomized, double-blind, placebo-controlled trial is designed to evaluate the efficacy and safety of ADI-58125 in the prevention of RT-PCR confirmed, symptomatic COVID-19.

The study involves 5,716 adult and adolescent participants whose locations or circumstances place them at high risk of acquiring SARS-CoV-2 and COVID-19. Baseline serology/RT-PCR will be collected with regards to SARS-CoV-2 status. The duration of this study is about 12 months for each participant which corresponds to 12 months follow-up after receipt of the treatment (300 mg ADI-58125 or placebo). The treatment (ADI-58125 or placebo) is given intramuscularly.

Treatment groups are divided as following:

| Strata | Dosage IM (once) 1:1 | Sample size |
|---|---|---|
| Known recent exposure to confirmed case | 300 mg, placebo | 40% |
| No known recent exposure | 300 mg, placebo | 60% |
| ≥65 years | 300 mg, placebo | |
| 12 to <65 years at increased risk for severe COVID-19 ("at risk") | 300 mg, placebo | |
| 12 to <65 and not at risk | 300 mg, placebo | |

The results of this study demonstrate the immediate and durable efficacy of ADI-58125 in preventing COVID-19 in a broad population.

Example 34: A Phase 1/2/3 Randomized, Double-Blind, Placebo-Controlled Clinical Trial to Evaluate the Efficacy and Safety of ADI-58125 in the Treatment of Ambulatory Participants with Mild or Moderate COVID-19

A phase 1/2/3 randomized, double-blind, placebo-controlled trial is designed to evaluate the efficacy and safety of ADI-58125 in the treatment of mild or moderate COVID-19 in participants at high risk of disease progression.

This study involves 1,734 high risk adult and adolescent participants with mild or moderate COVID-19 with symptom duration of 5 days or less and a positive SARS-CoV-2 test. The study lasts for approximately 6 months for each participant which corresponds to 6 months follow-up after receipt of the treatment (ADI-58125 or placebo). The treatment (ADI-58125 or placebo) is given either intravenously or intramuscularly.

Treatment groups are divided as following:

| Strata | Dosage (once) 2:2:1:1 |
|---|---|
| >65 years | 600 mg IM, 1200 mg IV, placebo IM, placebo IV |
| 18 to 65 years | 300 mg, placebo |
| 12 to 17 | 300 mg, placebo |
| Geographic location | 600 mg IM, 1200 mg IV, placebo IM, placebo IV |

Example 35: Dose Regimen Selection by a Model Based Approach

A QSP/PBPK model was developed and modified to characterize extended half-life monoclonal antibody pharmacokinectics (PK), including the impact of drug-specific physiochemical properties. Non-human primate PK data was used to evaluate the model through comparison of predicted and measured concentrations. The model was then re-fitted to better describe the measured PK and used to select doses for the prevention trial in human.

To support the dose justification for treatment, the QSP/PBSK model was further modified by replacing the lung compartment with distinct upper and lower airway compartments, the two key sites of ADI-58125 interaction with SARS-Cov-2, and linking the model to viral time-course of infection model.

Figure 46:
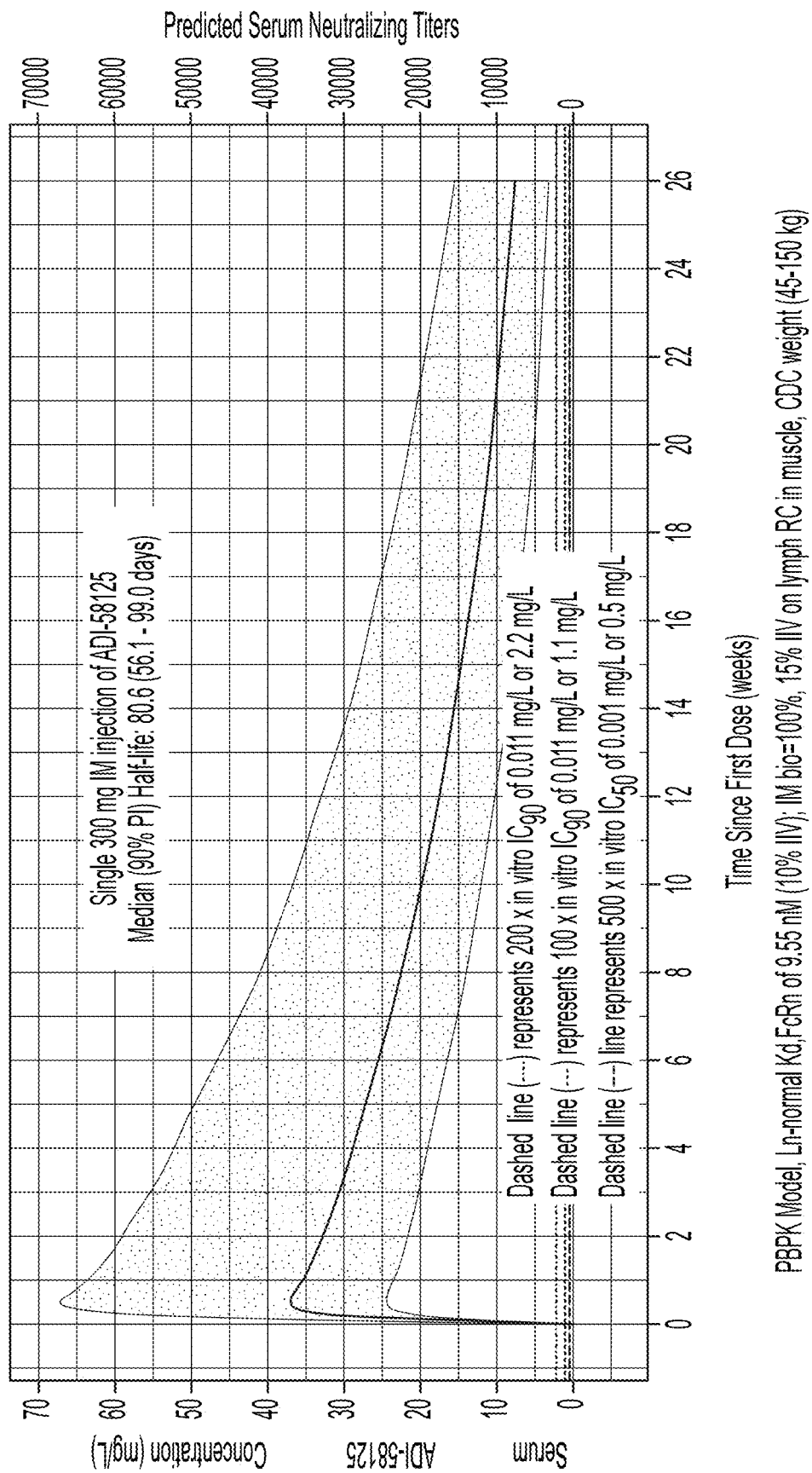
FIG. 46 depicts the serum concentration of ADI-58125 and the predicted serum neutralizing titers following a single 300 mg intramuscular (IM) dose.

For dose selection for prevention, greater than 90% of simulated patients were predicted to maintain serum ADI-58125 concentrations above 100 to 200 times of the in vitro IC90 for a minimum of 6 months following a single 300 mg intramuscular (IM) dose (FIG. 46). Doses of 150 and 450 mg showed similar results (data not shown) Similarly, greater than 90% of simulated patients were expected to maintain ADI-58125 lung interstitial fluid concentrations greater than 18 times of the in vitro IC90 for over 6 months. Greater than 90% of simulated patients were expected to maintain ADI-58125 concentrations greater than 500 times of the in vitro IC50 for a minimum of 6 months. This threshold is similar to the 50% SARS-CoV-2 geometric mean titer observed on Day 35 (7 days after second vaccine dose) with the COVID-19 vaccine BNT62b1 (Mulligan, 2020), which was recently announced to have achieved >90% efficacy in the prevention of COVID-19 at 7 days after the second dose (Pfizer, 2020).

Figure 47A:
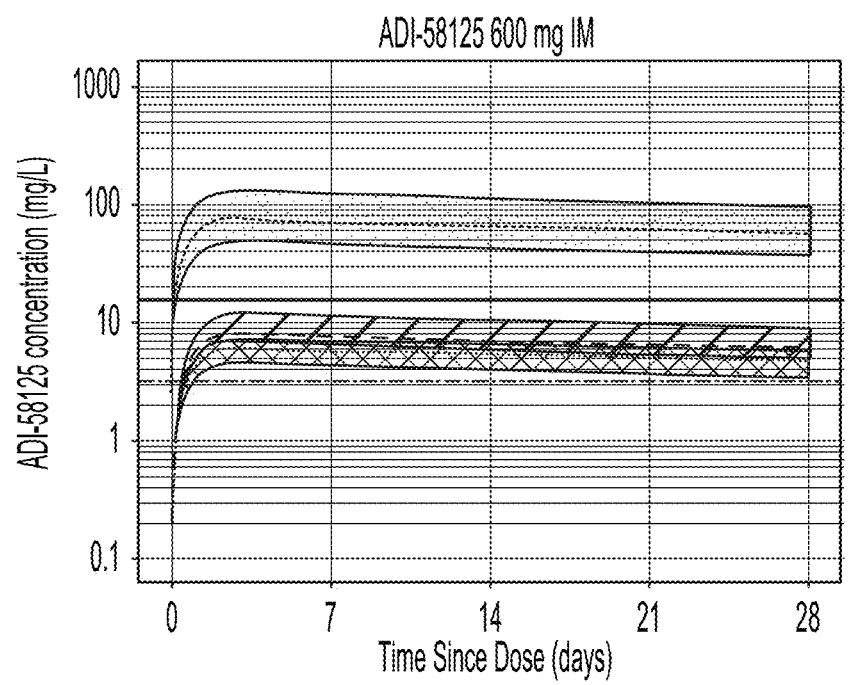
FIG. 47A depicts the serum concentration of ADI-58125 and the upper and lower respiratory ELF concentrations following a single dose of 600 mg IM.
Figure 47B:
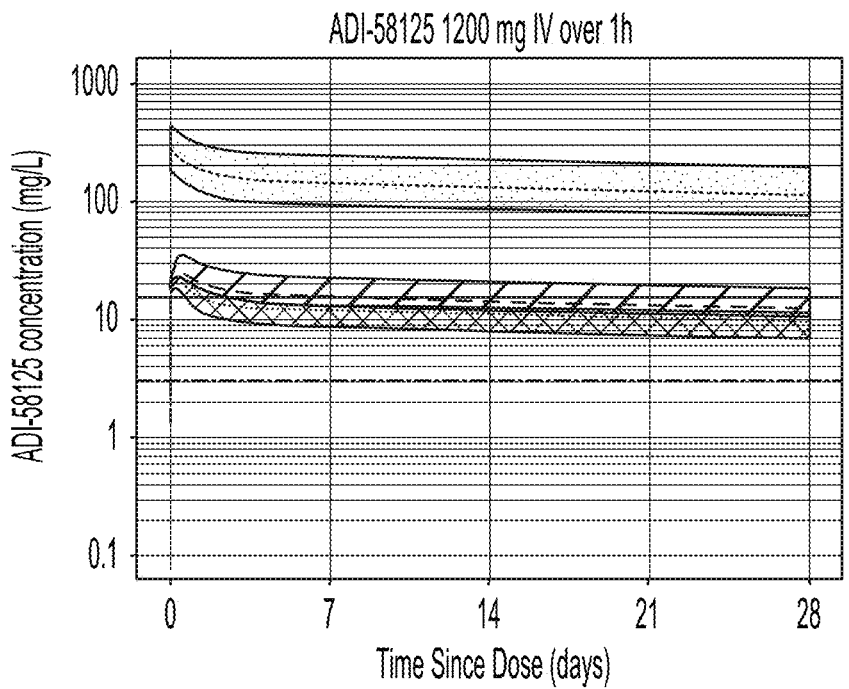
FIG. 47B depicts the serum concentration of ADI-58125 and the upper and lower respiratory ELF concentrations following a single 1200 mg intravenous (IV) dose over 1 hour.
Figure 47C:
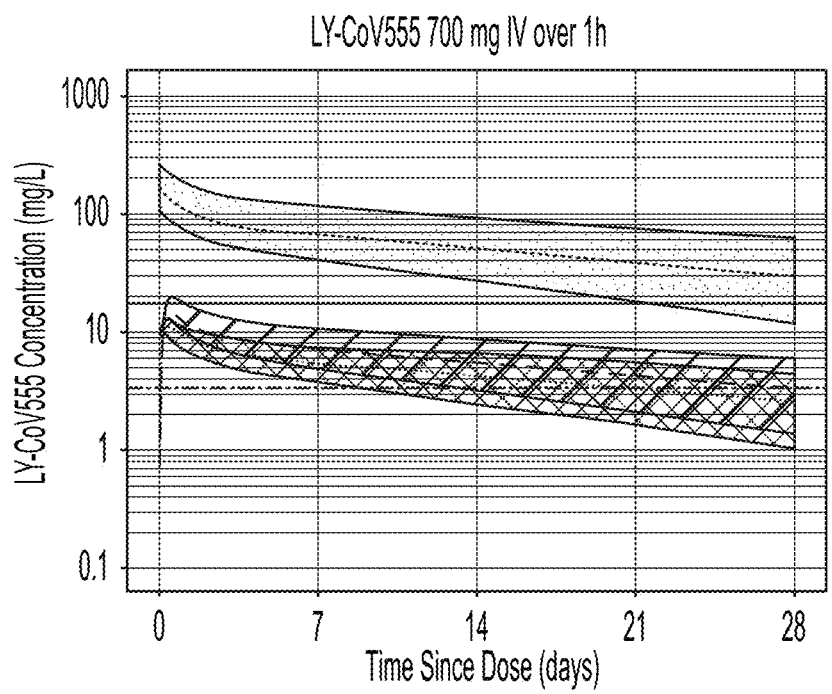
FIG. 47C depicts the serum concentration of LY-CoV555 and the upper and lower respiratory ELF concentrations following a single dose of 700 mg IV over 1 hour.
Figure 47D:
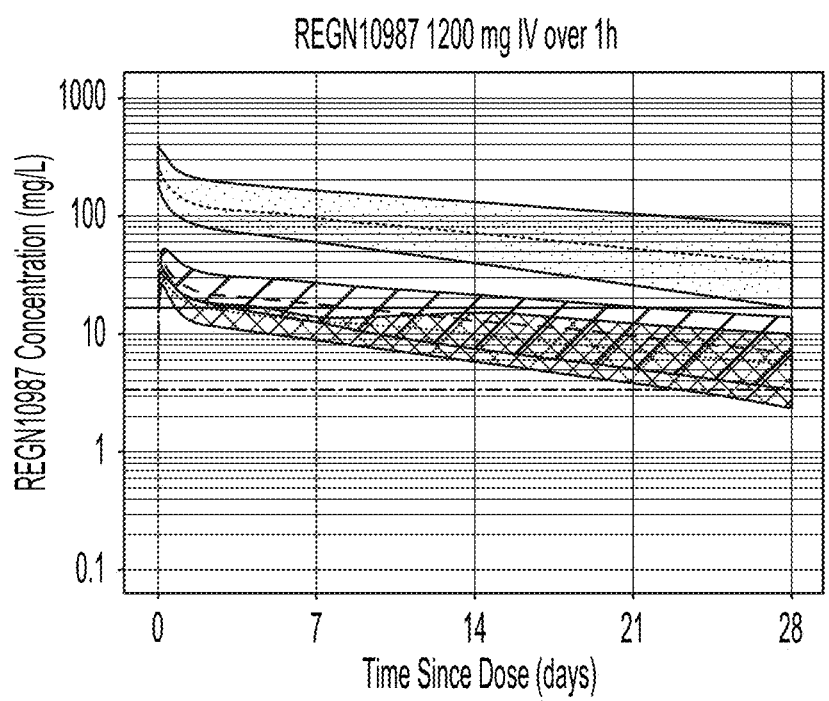
FIG. 47D depicts the serum concentration of REGN10987 and the upper and lower respiratory ELF concentrations following a single dose of 1200 mg IV over 1 hour.

For dose selection for treatment, greater than 90% of simulated patients were predicted to maintain serum neutralizing antibody concentrations greater than 500 times of the in vitro IC50 and upper and lower respiratory ELF concentrations greater than 100 times of the in vitro $IC_{50}$ for a minimum of 28 days following a single dose of 600 mg IM (FIG. 47A) or a single dose of 1200 mg IV over 1 hour (FIG. 47B). In contrast, the LY-CoV555 regimen maintains serum neutralizing antibody concentrations greater than 500 times of the in vitro IC50 for only 21 days in >90% of patients (FIG. 47C) and neither the LY-CoV555 or REGN10987 regimen maintains ELF targets beyond Day 21 in >90% of patients (FIG. 47D).

Figure 48B:
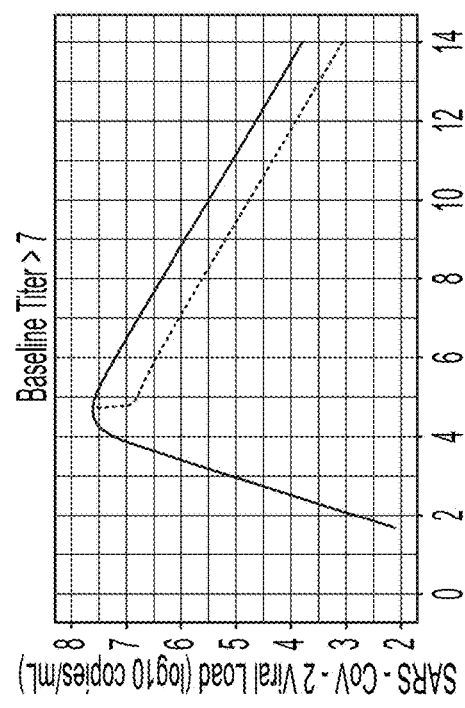
FIG. 48B depicts the viral load following a single dose of 1200 mg IV ADI-58125 and 2400 mg IV REGN-COV2.
Figure 48D:
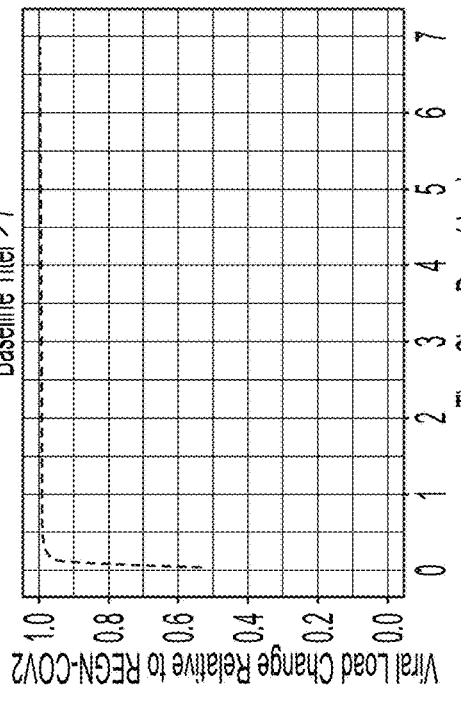
FIG. 48D depicts the viral load change relative to REGN-COV2 following a single dose of 1200 mg IV ADI-58125 and 2400 mg IV REGN-COV2.
Figure 48A:
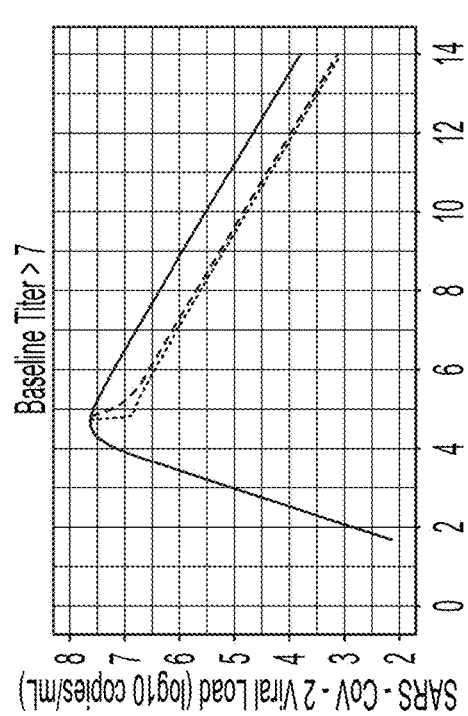
FIG. 48A depicts the viral load following a single dose of 600 mg IM ADI-58125 and 2400 mg IV REGN-COV2.
Figure 48C:
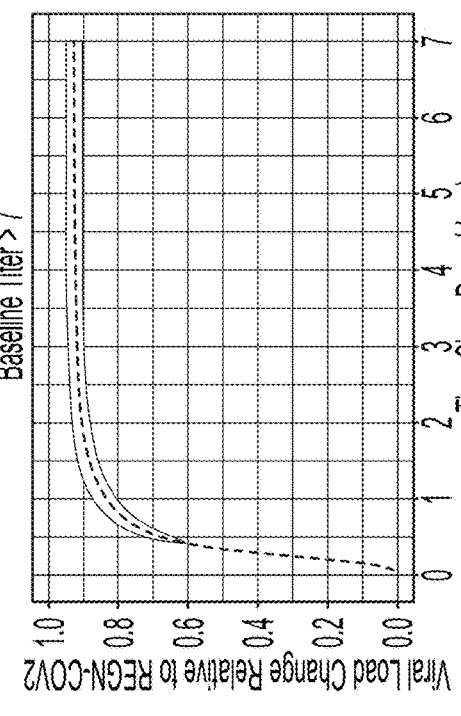
FIG. 48C depicts the viral load change relative to REGN-COV2 following a single dose of 600 mg IM ADI-58125 and 2400 mg IV REGN-COV2.

The impact of the selected treatment dosage for ADI-58125 (600 IM and 1200 mg IV) on viral dynamics was also assessed relative to that of REGN-COV2 (casirivimab/imdevimab) 2400 mg IV in subjects with a high baseline viral load (>$10^7$ copies/mL). The median effect of the ADI-58125 600 mg IM dose approached that of the REGN-COV2 regimen over a 1-day period (FIG. 48A); while the ADI-58125 1200 mg IV dose matched the effect of the REGN-COV2 regimen (FIG. 48B). The probability of ADI-58125 600 mg IM and ADI-58125 1200 mg IV matching the viral load change observed with the REGN-COV2 regimen was simulated in 1000-patients for each proposed dose level. The ADI-58125 600 mg IM dose approached 90% of the effect of the REGN-COV2 regimen over a 2-day period (FIG. 48C) and the ADI-58125 1200 mg IV dose matched the effect of the REGN-COV2 regimen immediately (FIG. 48D). While it is unknown if the delay in reaching maximal effect for the 600 mg IM dose impacts clinical outcomes, it is important to note that approximately 66% and 90% of this regimen's maximal effect was predicted to be achieved by 12 and 24 hours, respectively. Study of the IM regimen is further supported by the potential benefits to patients, providers and healthcare systems alike given the relative ease of administration of this regimen in the outpatient setting for ambulatory patients with COVID-19.

Example 36: A Phase 1, Randomized, Double-Blind, Single Ascending Dose Study Evaluating Safety, Tolerability, and PK of ADI-58125 in Healthy Participants A phase I, randomized, double-blinded, single ascending dose study is designed to evaluate the safety, tolerability and pharmacokinetics of ADI-58125 in healthy participants.

This study involves healthy volunteers with an age of about 18-50. Participants are divided into three dose cohorts: 300 mg IM (intramuscular), 500 mg IV (intravenous), or 600 mg IM. Each cohort comprises 10 participants, where 8 individuals receive active treatment and 2 individuals receive a placebo control.

Example 37: A Non-Clinical Safety Study

In a GLP rat 22-day repeat-dose study, there were no ADI-58125-associated toxicity findings, including no local injection site reactions. No off-target binding of ADI-58125 to human tissues was observed in a human tissue cross-reactivity IHC study, supporting use of the rat as an appropriate species for toxicity assessment.

Human Cross-Tissue Reactivity Data

Immunohistochemistry (IHC) staining methods were used to determine the binding activity of the biotinylated test article, Biotin-ADI-58125, and control article, Biotin-562, with a panel of 37 different frozen normal human tissues. Phosphate-buffered saline (PBS, 0.1 mol/L) was the reagent control. Streptavidin-peroxidase and stable diaminobenzidine (DAB) were used for color development. Positive control cells were 200221_165_S9sh) cells (SARS-CoV-2 Spike protein transfected HEK293 cells) and negative cells were non-transfected HEK293 cells. Both test article and control article were biotinylated during method development and validation study. Frozen normal human tissues were validated with anti-CD31 (anti-endothelial cells) monoclonal antibody staining.

No specific Biotin-ADI-58125 staining was observed in frozen human tissues and no human tissue sections had positive membrane staining by IHC with Biotin-ADI-58125. Therefore, there was no cross-reactivity (off-target binding) of ADI-58125 to normal human tissues.

GLP Rat Toxicity Study

One hundred and seventy Sprague-Dawley (SD) rats (85/sex) were randomly assigned to 4 groups to determine the toxicity and toxicokinetics of ADI-58125 when administered once weekly (on Days 1, 8, 15, and 22) by IV infusion (30 or 300 mg/kg) or IM injection (30 mg/kg) compared to control group. Five rats/sex from 300 mg/kg IV, 30 mg/kg IM, and control group were allocated for a 21-day recovery observation. The scheduled necropsied were conducted on Days 23 (dosing phase) and 44 (recovery phase). Criteria for evaluation included viability (morbidity and mortality), clinical observations, body weight, food consumption, clinical pathology (hematology, serum chemistry, coagulation, and urinalysis), organ weight, gross observations, histopathology evaluation, and TK. Study design was agreed to with the FDA prior to initiation.

Once-weekly administration of ADI-58125 to adult rats for 22 days (4 doses in total) by IV infusion up to 300 mg/kg/dose or by IM injection at 30 mg/kg/dose did not result in any test article related mortality or adverse effects. The no observed adverse effect level (NOAEL) was considered to be 300 mg/kg/dose for IV infusion and 30 mg/kg/dose for IM injection.

Example 38: A Preclinical PK/PD Study: Non-GLP Pharmacokinetics in Non Human Primates A non-GLP pharmacokinestic study was performed in non human primates (NHPs). As shown in FIG. 49A, there was no sex differences in PK or mean serum concentration after IV infusion or IM injection of ADI-58125 at a dose of 10 mg/kg in male and female cynomolgus monkeys.

Pharmacokinetic parameters were evaluated. A long half-life was confirmed with an average of about 473h following IV administration and about 533h following IM administration, as well as a bioavailability of ~100% (FIG. 49B).

Figure 50B:
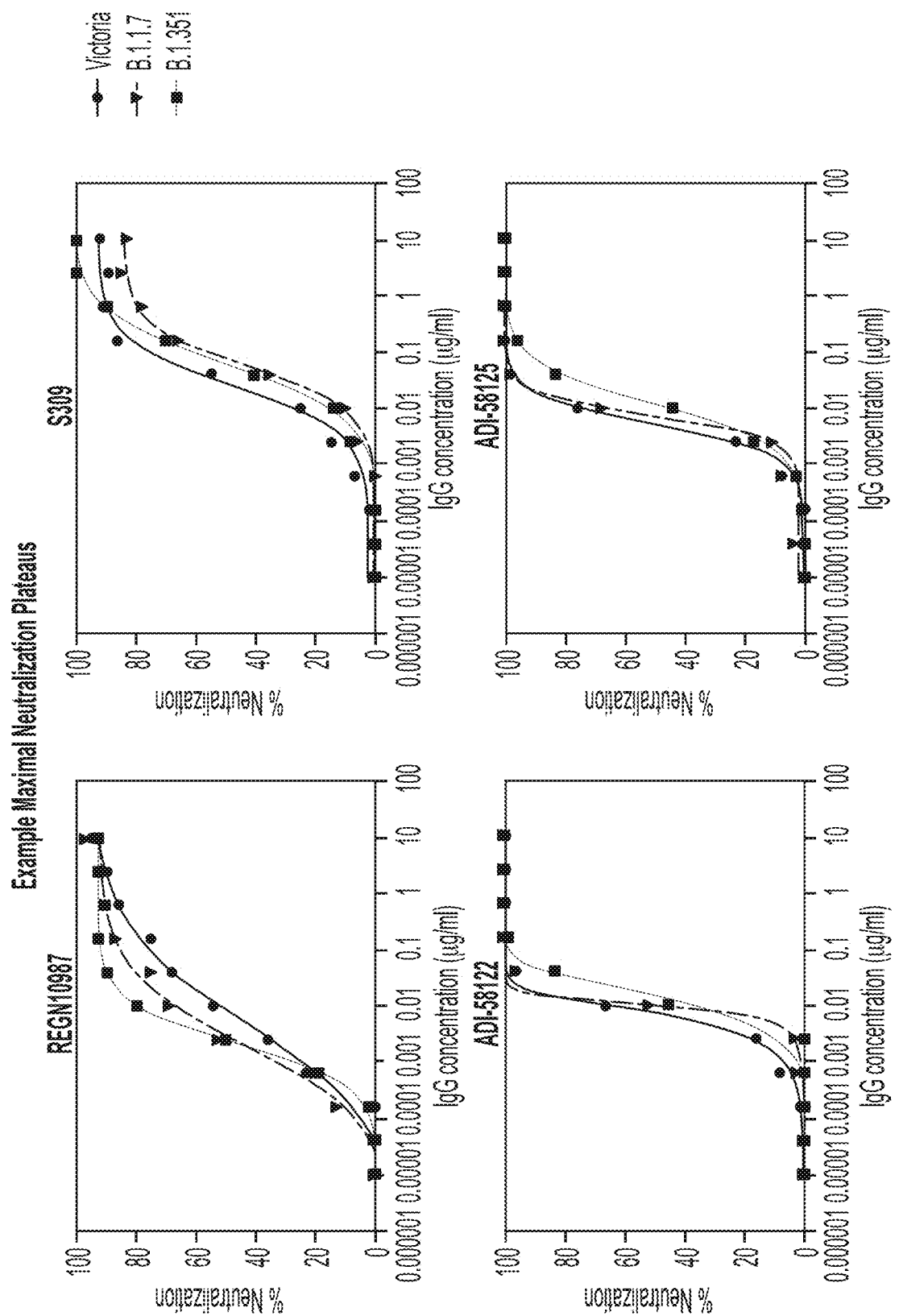
Figure 51:
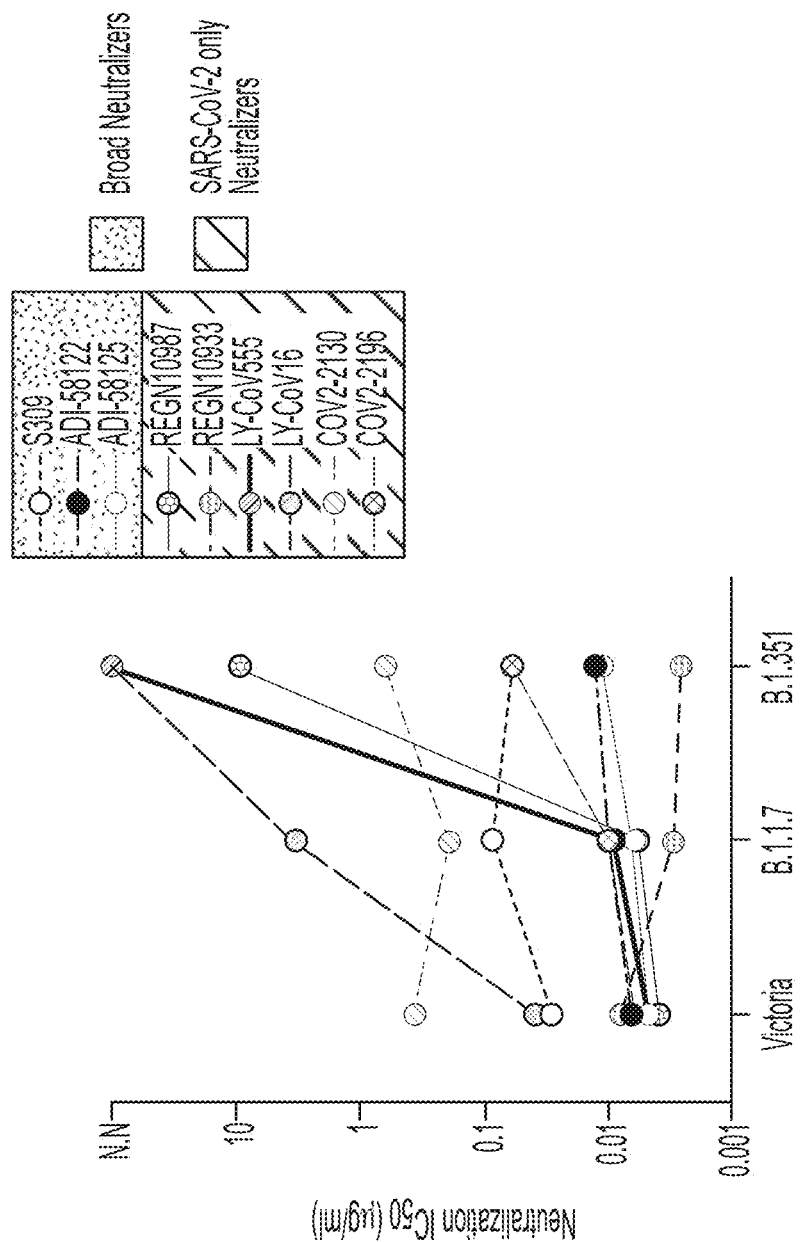
FIG. 51 depicts that neutralization IC50 for selected antibodies against the Victoria, UK (B.1.1.7) and South African (B.1.351) SARS-CoV-2 variants.

Example 39: ADI-58122 and ADI-58125 Potently Neutralize UK (B.1.1.7), South African (B.1.351) Brazilian (B.1.1.128), and B.1.429 (Southern California) SARS-CoV-2 Variants Neutralization assays were performed for ADI-58122 and ADI-58125 on the UK (B.1.1.7) and South African (B.1.351) SARS-CoV-2 variants, as described above. As shown in FIGS. 50A-50C, both ADI-58122 and ADI-58125 potently neutralize UK (B.1.1.7), South African (B.1.351) and/or Brazilian (P.1) SARS-CoV-2 variants with an IC50 less than 0.05 µg/mL and with 100% neutralization plateau. These two broad neutralizers had a lower neutralization IC50 value against the UK and South African strains than most of the SARS-CoV-2 only neutralizers (FIG. 51).

Figure 52A:
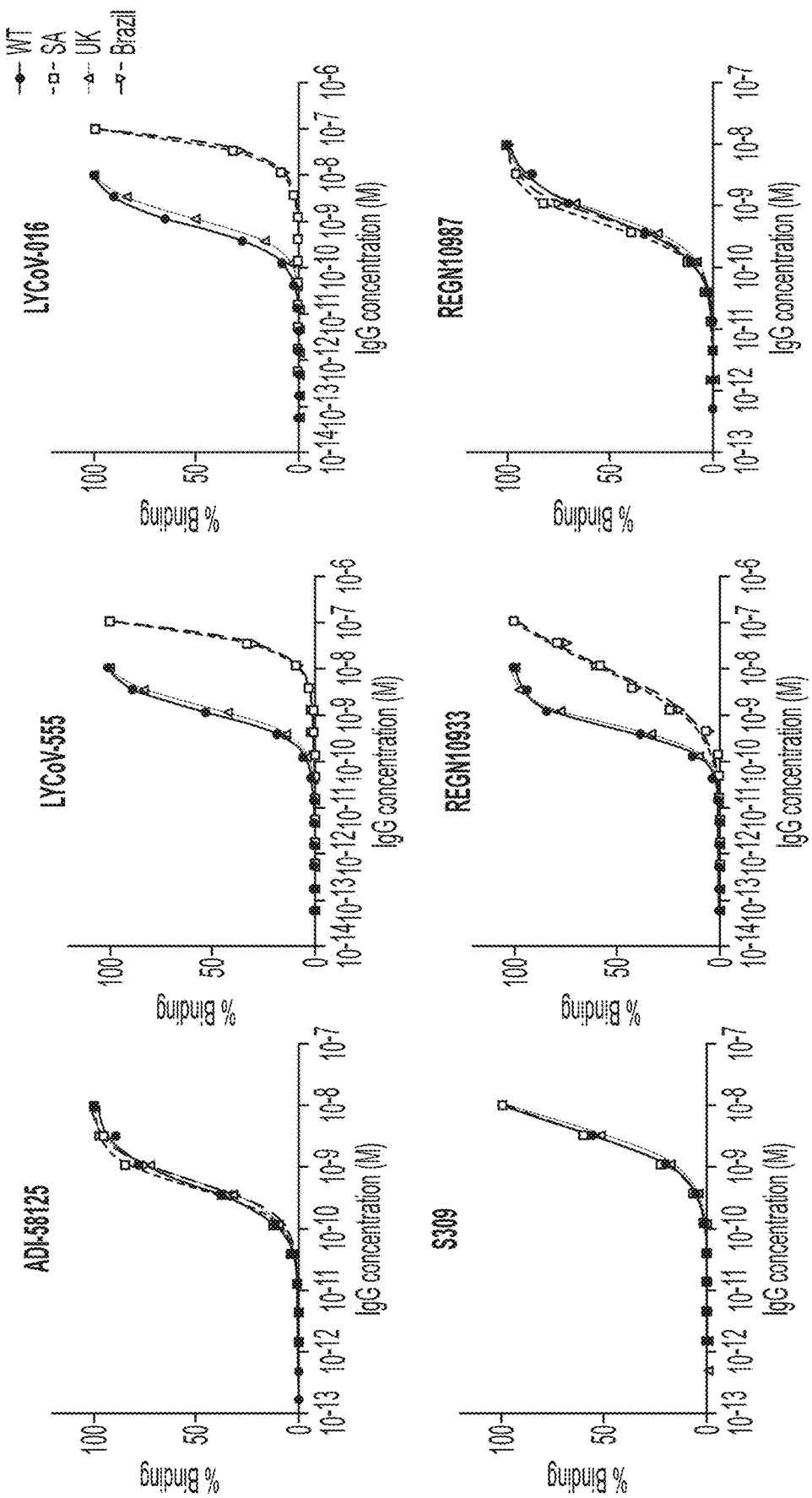
FIG. 52A depicts that ADI-58125 retains high binding affinity to the RBDs of the B.1.1.7 (UK), B.1.351 (South African) and B.1.1.128 (Brazilian) variants.
Figures 52B, 53A:
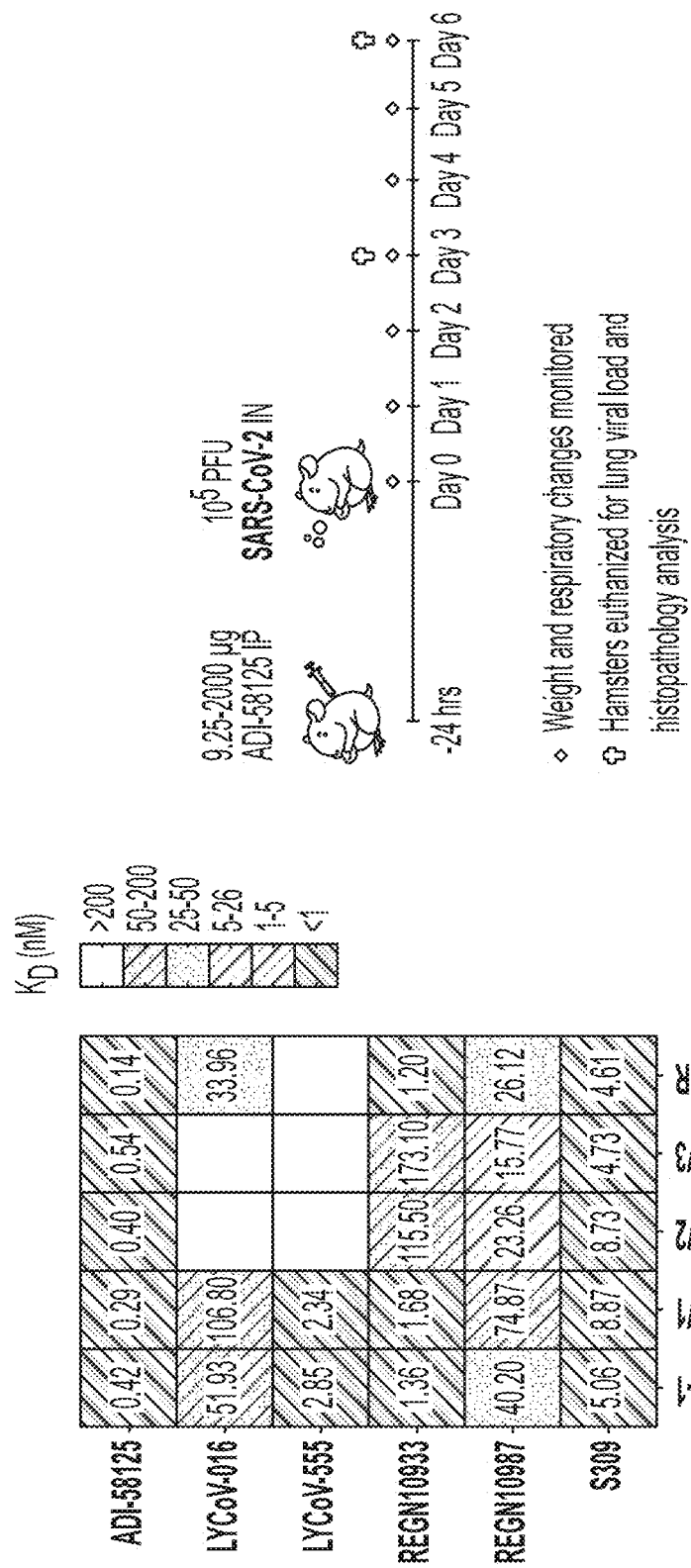
FIG. 52B depicts that ADI-58125 retains high binding affinity to the RBDs of the B.1.1.7 (UK), B.1.351 (South African), B.1.1.128 (Brazilian) and B.1.429 (southern California) variants.
FIG. 53A is a schematic representation for the in vivo efficacy study in hamsters. Hamsters were treated with a range of ADI-58125 doses (9.25-2000 μg) or control mAb 24 hours prior to challenge with SARS-2/WA-1 to evaluate prophylactic efficacy of ADI-58125.

Binding affinity was also assessed for ADI-58125 against the Brazilian SARS-CoV-2 variant (B.1.1.128) and the newly emerging variant in southern California (B.1.429) in addition to the UK (B.1.1.7) and South African (B.1.351) SARS-CoV-2 variants. As shown in FIGS. 52A and 52B, ADI-58125 retains high binding affinity to the RBDs of all four variants, whereas other antibodies, for example, LYCoV-555, LYCoV-016 and REGN10933, were less effective in binding to the RBD of the variants, for example the South African variant or the southern California variant.

Example 40: In Vivo Efficacy Study in Hamster

The prophylactic efficacy of ADI-58125 was assessed in vivo in hamster. Briefly, 5-6 week old female Syrian hamsters were dosed intraperitoneally with a range of ADI-58125 doses (n=40; 9.25-2000 µg) or control mAb (sham isotype matched IgG) (n=20; either 9.25 or 2000 µg) 24 hours prior to intranasal challenge with 1e5 pfu of SARS-2/WA-1 to evaluate prophylactic efficacy of ADI-58125 (FIG. 53A). Prior to viral challenge, serum antibody titres were measured. The prophylactic efficacy of ADI-58125 was assessed by viral load (plaque assay, genomic RT-PCR, subgenomic RT-PCR), body weight, and histopathology. Hamseters were weighed daily over 6 days. On days 3 and 6, antibody titre, viral load and lung histopathology were assessed.

Figure 53C:
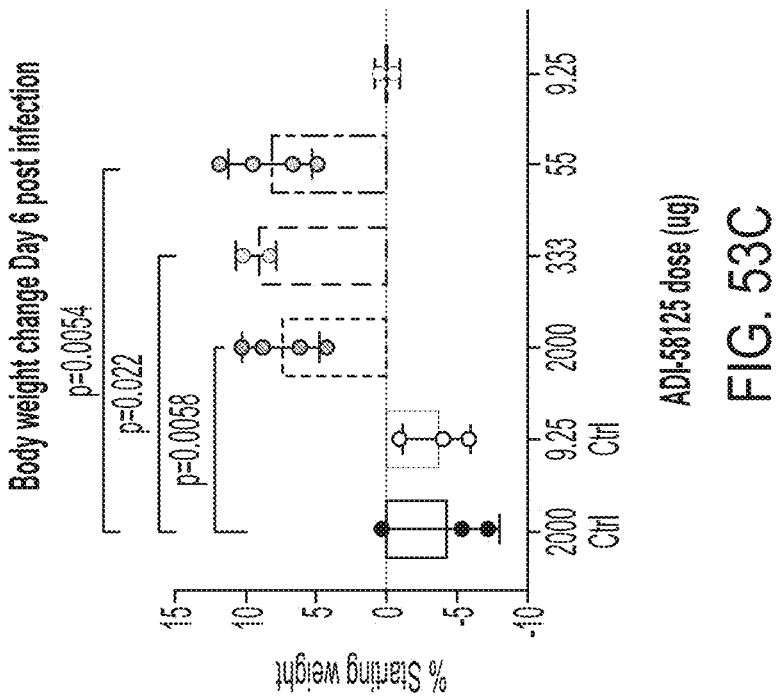
FIGS. 53B and 53C depict the prophylactic efficacy of ADI-58125 in the Syrian hamster model of SARS-CoV-2 infection as assessed by viral load (plaque assay, genomic RT-PCR, subgenomic RT-PCR), body weight, and histopathology.
Figure 53B:
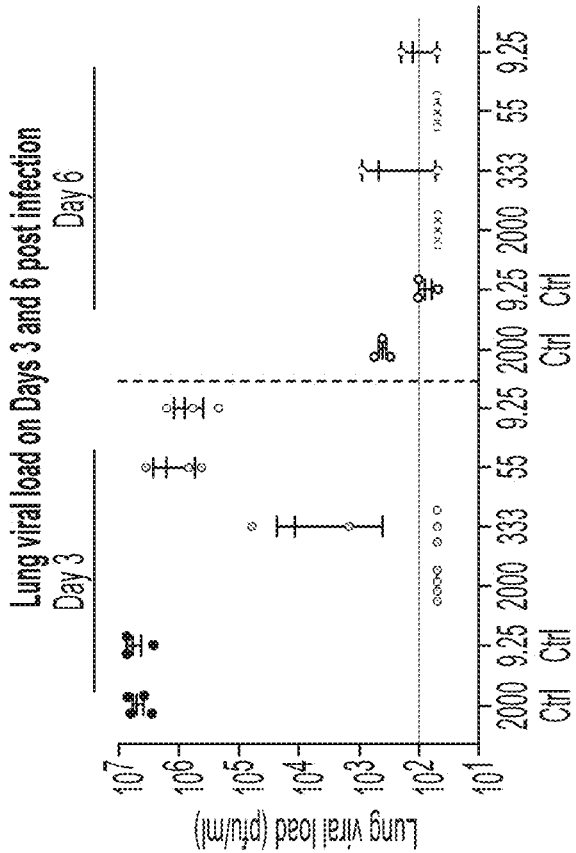

As shown in FIG. 53B, an ADI-58125 dose dependent decrease in viral load was observed. Specifically, hamsters receiving the highest dose (2000 µg) had no detectable virus in lung samples. Similar trends were observed for genomic-RNA and sub-genomic-RNA (data not shown). An ADI-58125 dose of ≥55 µg was associated with protection from weight loss compared with controls (FIG. 53C), and hamsters receiving 333 and 2000 µg doses displayed limited histopathological evidence of pneumonia (data not shown). These data demonstrated that prophylactic administration of ADI-58125 provides dose-dependent protection from SARS-CoV-2 infection in the Hamster model.

Example 41: In Vivo Efficacy Study in Non Human Primates

Figure 54A:
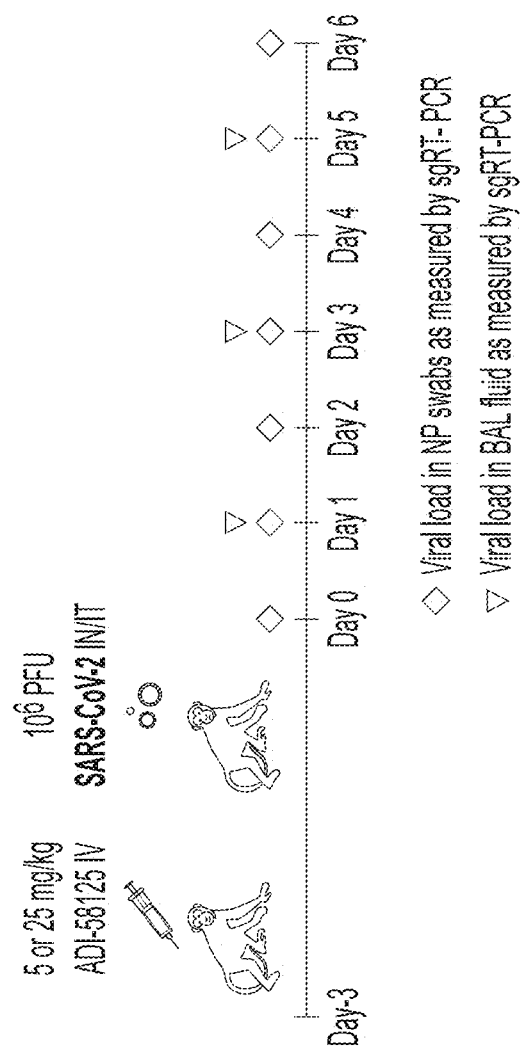
FIG. 54A is a schematic representation for the in vivo efficacy study in non-human primates (NHP). Rhesus macaques were treated with ADI-58125 at 5 mg/kg or 25 mg/kg, or control mAb (25 mg/kg) 3 days prior to challenge with SARS-2/WA-1 to evaluate prophylactic efficacy of ADI-58125.
Figure 54B:
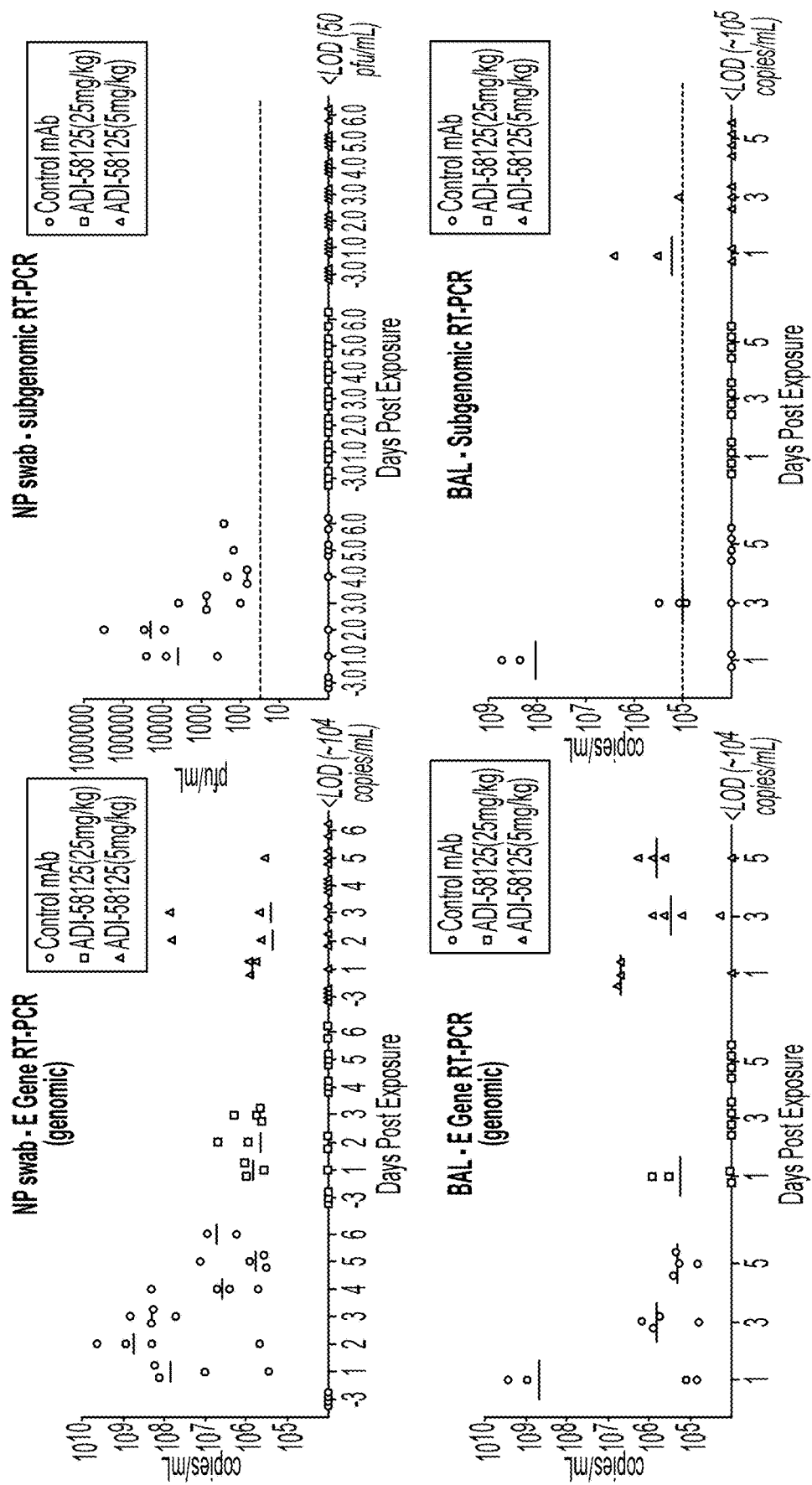
FIG. 54B depicts the prophylactic efficacy of ADI-58125 in the NHP model of SARS-CoV-2 infection: impact on genomic (left panels) and sub-genomic (right panels) viral RNA in NP and BAL samples. BAL, bronchoalveolar lavage; NP, nasopharyngeal; RT-PCR, reverse transcription-polymerase chain reaction.

The prophylactic efficacy of ADI-58125 was further assessed in vivo in non human primates (NHP). Briefly, rhesus macaques (>3 years of age at time of challenge; 3-10 kg in weight; 4/arm) were dosed intravenously with ADI-58125 at 5 mg/kg or 25 mg/kg (n=8), or control mAb (25 mg/kg, n=4) 3 days prior to intranasal/intratracheal challenge with 1e6 pfu of SARS-2/WA-1 to evaluate prophylactic efficacy of ADI-58125 (FIG. 54A). Prior to viral challenge, blood samples were collected and daily pharmacokinetic samples and viral (nasopharyngeal, oropharyngeal (daily) and broncholaveolar lavage (days 1, 3, and 5) were assessed. The prophylactic efficacy of ADI-58125 was assessed by viral load (plaque assay, genomic RT-PCR, subgenomic RT-PCR), clinical disease on chest radiograph and histopathology. In the NHP model, accelerated clearance of genomic RNA with no detection of sub-genomic RNA was observed at the 20 mg/kg dose in both nasopharyngeal and bronchoalveolar lavage samples, demonstrating a significant impact of ADI-58125 on viral replication in the upper and lower airways (FIG. 54B). No evidence of enhanced viral replication at any ADI-58125 dose level was observed in either hamster or NHP animal model. These data demonstrated that ADI-58125 confers potent protection from SARS-CoV-2 infection at dose ranges from 5-25 mg/kg in a NHP model. These results support further investigation of ADI-58125 for the prevention of COVID-19 in humans.

TABLE 5.

Summary of Antibody names (ADI ID) and Index Nos.

| Index No. | ADI ID |
|---|---|
| 1 | ADI-55688 |
| 2 | ADI-55689 |
| 3 | ADI-55690 |
| 4 | ADI-55691 |
| 5 | ADI-55692 |
| 6 | ADI-55693 |
| 7 | ADI-55694 |
| 8 | ADI-55695 |
| 9 | ADI-55696 |
| 10 | ADI-55697 |
| 11 | ADI-55698 |
| 12 | ADI-55699 |
| 13 | ADI-55700 |
| 14 | ADI-55701 |
| 15 | ADI-55702 |
| 16 | ADI-55703 |
| 17 | ADI-55704 |
| 18 | ADI-55705 |
| 19 | ADI-55706 |
| 20 | ADI-55707 |
| 21 | ADI-55708 |
| 22 | ADI-55709 |
| 23 | ADI-55710 |
| 24 | ADI-55711 |
| 25 | ADI-55712 |
| 26 | ADI-55713 |
| 27 | ADI-55714 |
| 28 | ADI-55715 |
| 29 | ADI-55716 |
| 30 | ADI-55717 |
| 31 | ADI-55718 |
| 32 | ADI-55719 |
| 33 | ADI-55721 |
| 34 | ADI-55722 |
| 35 | ADI-55723 |
| 36 | ADI-55724 |
| 37 | ADI-55725 |

TABLE 5.-continued

Summary of Antibody names
(ADI ID) and Index Nos.

| Index No. | ADI ID |
|---|---|
| 38 | ADI-55726 |
| 39 | ADI-55727 |
| 40 | ADI-55728 |
| 41 | ADI-55729 |
| 42 | ADI-55730 |
| 43 | ADI-55731 |
| 44 | ADI-55732 |
| 45 | ADI-55733 |
| 46 | ADI-55734 |
| 47 | ADI-55735 |
| 48 | ADI-55736 |
| 49 | ADI-55737 |
| 50 | ADI-55738 |
| 51 | ADI-55739 |
| 52 | ADI-55740 |
| 53 | ADI-55741 |
| 54 | ADI-55742 |
| 55 | ADI-55743 |
| 56 | ADI-55744 |
| 57 | ADI-55745 |
| 58 | ADI-55746 |
| 59 | ADI-55747 |
| 60 | ADI-55748 |
| 61 | ADI-55749 |
| 62 | ADI-55750 |
| 63 | ADI-55751 |
| 64 | ADI-55752 |
| 65 | ADI-55753 |
| 66 | ADI-55754 |
| 67 | ADI-55755 |
| 68 | ADI-55756 |
| 69 | ADI-55757 |
| 70 | ADI-55758 |
| 71 | ADI-55720 |
| 72 | ADI-55760 |
| 73 | ADI-55761 |
| 74 | ADI-55762 |
| 75 | ADI-55763 |
| 76 | ADI-55765 |
| 77 | ADI-55766 |
| 78 | ADI-55767 |
| 79 | ADI-55769 |
| 80 | ADI-55770 |
| 81 | ADI-55771 |
| 82 | ADI-55775 |
| 83 | ADI-55776 |
| 84 | ADI-55777 |
| 85 | ADI-55950 |
| 86 | ADI-55951 |
| 87 | ADI-55952 |
| 88 | ADI-55953 |
| 89 | ADI-55954 |
| 90 | ADI-55955 |
| 91 | ADI-55956 |
| 92 | ADI-55957 |
| 93 | ADI-55958 |
| 94 | ADI-55959 |
| 95 | ADI-55960 |
| 96 | ADI-55961 |
| 97 | ADI-55962 |
| 98 | ADI-55963 |
| 99 | ADI-55964 |
| 100 | ADI-55965 |
| 101 | ADI-55966 |
| 102 | ADI-55967 |
| 103 | ADI-55968 |
| 104 | ADI-55969 |
| 105 | ADI-55970 |
| 106 | ADI-55972 |
| 107 | ADI-55973 |
| 108 | ADI-55974 |
| 109 | ADI-55975 |
| 110 | ADI-55976 |
| 111 | ADI-55977 |

TABLE 5.-continued

Summary of Antibody names (ADI ID) and Index Nos.

| Index No. | ADI ID |
|---|---|
| 112 | ADI-55978 |
| 113 | ADI-55979 |
| 114 | ADI-55980 |
| 115 | ADI-55981 |
| 116 | ADI-55982 |
| 117 | ADI-55984 |
| 118 | ADI-55986 |
| 119 | ADI-55988 |
| 120 | ADI-55989 |
| 121 | ADI-55990 |
| 122 | ADI-55992 |
| 123 | ADI-55993 |
| 124 | ADI-55994 |
| 125 | ADI-55995 |
| 126 | ADI-55996 |
| 127 | ADI-55997 |
| 128 | ADI-55998 |
| 129 | ADI-55999 |
| 130 | ADI-56000 |
| 131 | ADI-56001 |
| 132 | ADI-56002 |
| 133 | ADI-56003 |
| 134 | ADI-56004 |
| 135 | ADI-56005 |
| 136 | ADI-56006 |
| 137 | ADI-56007 |
| 138 | ADI-56008 |
| 139 | ADI-56009 |
| 140 | ADI-56010 |
| 141 | ADI-56011 |
| 142 | ADI-56012 |
| 143 | ADI-56013 |
| 144 | ADI-56014 |
| 145 | ADI-56015 |
| 146 | ADI-56016 |
| 147 | ADI-56017 |
| 148 | ADI-56018 |
| 149 | ADI-56019 |
| 150 | ADI-56020 |
| 151 | ADI-56021 |
| 152 | ADI-56022 |
| 153 | ADI-56023 |
| 154 | ADI-56024 |
| 155 | ADI-56025 |
| 156 | ADI-56026 |
| 157 | ADI-56027 |
| 158 | ADI-56028 |
| 159 | ADI-56029 |
| 160 | ADI-56030 |
| 161 | ADI-56031 |
| 162 | ADI-56032 |
| 163 | ADI-56033 |
| 164 | ADI-56034 |
| 165 | ADI-56035 |
| 166 | ADI-56037 |
| 167 | ADI-56038 |
| 168 | ADI-56039 |
| 169 | ADI-56040 |
| 170 | ADI-56041 |
| 171 | ADI-56042 |
| 172 | ADI-56043 |
| 173 | ADI-56044 |
| 174 | ADI-56045 |
| 175 | ADI-56046 |
| 176 | ADI-56047 |
| 177 | ADI-56048 |
| 178 | ADI-56049 |
| 179 | ADI-56050 |
| 180 | ADI-56051 |
| 181 | ADI-56052 |
| 182 | ADI-56053 |
| 183 | ADI-56054 |
| 184 | ADI-56055 |
| 185 | ADI-56056 |

TABLE 5.-continued

Summary of Antibody names (ADI ID) and Index Nos.

| Index No. | ADI ID |
|---|---|
| 186 | ADI-56057 |
| 187 | ADI-56058 |
| 188 | ADI-56059 |
| 189 | ADI-56061 |
| 190 | ADI-56062 |
| 191 | ADI-56063 |
| 192 | ADI-56064 |
| 193 | ADI-56065 |
| 194 | ADI-56066 |
| 195 | ADI-56067 |
| 196 | ADI-56068 |
| 197 | ADI-56069 |
| 198 | ADI-56070 |
| 199 | ADI-56071 |
| 200 | ADI-56072 |
| 201 | ADI-56073 |
| 202 | ADI-56074 |
| 203 | ADI-56075 |
| 204 | ADI-56076 |
| 205 | ADI-56078 |
| 206 | ADI-56079 |
| 207 | ADI-56080 |
| 208 | ADI-56081 |
| 209 | ADI-56082 |
| 210 | ADI-56083 |
| 211 | ADI-56084 |
| 212 | ADI-57983 (with primer mutation) |
| 213 | ADI-57978 (with primer mutation) |
| 214 | ADI-56868 (with primer mutation) |
| 215 | ADI-56443 (with primer mutation) |
| 216 | ADI-56479 (with primer mutation) |
| 217 | ADI-57983 (Fc variant: WT) |
| 218 | ADI-57983 (Fc Variant: YTE) |
| 219 | ADI-57983 (Fc Variant: LA) |
| 220 | ADI-57983 (Fc Variant LS) |
| 221 | AIM-57983 (Fc Variant: LA-RE) |
| 222 | ADI-57978 (Fc Variant WT) |
| 223 | AIM-57978 (Fc Variant: LA) |
| 224 | AIM-56868 (Fc Variant WT) |
| 225 | AIM-56868 (Fc Variant: LA) |
| 226 | AIM-56443 (Fc Variant WT) |
| 227 | AIM-56479 (Fc Variant WT) |

Having fully described and enabled the invention, the invention is further described by the claims that follow. In general, in the following claims, the terms used should not be construed to limit the disclosure to the specific embodiments disclosed in the specification and the claims. Accordingly, the invention is not limited by the disclosure, but instead the scope of the invention is to be determined entirely by the following claims.

The disclosure may be practiced in ways other than those particularly described in the foregoing description and examples. Numerous modifications and variations of the disclosure are possible in light of the above teachings and, therefore, are within the scope of the appended claims.

SEQUENCE LISTING (23257 sequences)

SEQ ID NO: 1 - protein, 1288 aa, Severe acute respiratory syndrome coronavirus 2
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGSASSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQGSGYIPEAPRDGQAYVRKDGEWVLLSTFLGRSLEVLFQGPGHHHHHHHHSAWSHPQFEKGGGSGGGGSGGSAWSHPQFEK

SEQ ID NO: 2 - DNA, 3864 bp, Severe acute respiratory syndrome coronavirus 2
atgttcgtgttcctggtgctcctgcctctggtgagcagccagtgcgtgaacctgaccacccgaacccagctcccaccagcctacaccaacagctttacacggggcgtgtactaccctgacaaggtgttcagatctagcgtcctgcacagcactcaggacctcttcctgccgttcttcagcaacgtgacatggttccacgccatccacgtgagcggcacaaacggaaccaagcggtttgataaccccgtcctgccattcaatgatggagtttacttcgccagtaccgagaagagtaacatcatccggggctggatcttcggcaccaccctggatagcaaaacacagagcctcctgatcgtgaacaatgccacgaacgtcgtgatcaaggtgtgcgagttccagttttgcaatgatcctttcctgggtgtgtactaccacaagaacaacaagagctggatggaaagcgagttcagagtctacagcagcgccaacaactgcacattcgagtacgtctctcagccttttctgatggaccttgaggggaaacaaggcaacttcaagaacctgagagaattcgtgttcaagaacatcgacggctacttcaaaatctactccaagcacacacccatcaacctggtccgggacctccctcagggcttcagcgccctggaacccctggtcgacctgcccataggcatcaacataacgcggttccaaaccctgctggccctgcatagatcctacctgactcctggcgacagcagcagcggatggaccgccggagctgcagcctactatgtgggctacctgcaacctagaaccttcctgctgaagtacaacgagaacggcacaatcacagacgccgtcgactgcgccctggaccctctctctgagacaaagtgcaccctgaagtccttcaccgtggaaaagggcatctaccagaccagcaacttccgggtgcagcctacagagagcatcgtgcgatttccaaacattaccaacctctgccccttcggcgaggtgtttaacgccacaagatttgcctccgtttacgcctggaatagaaagagaatcagcaattgtgtggccgactactccgtgctgtataacagcgcctctttcagcaccttcaagtgctacggcgtttccccaacaaagctgaatgacctgtgcttcaccaacgtgtacgccgactccttcgtaattagaggcgatgaggtgcggcagatcgcaccaggccagaccggtaagatcgctgactacaactataagctgcctgatgattttacaggctgcgtgatcgcctggaactctaacaacctggatagcaaggtgggcggcaactacaactacctgtaccggctgtttcgcaagtctaacctgaaacctttcgagagagacatctccacagagatctaccaggccggttctacaccttgtaacggggtggaaggcttcaactgttacttccctctgcaaagctacggcttccagcctaccaatggagtcggctaccagccataccgggtggtcgtgctgtccttcgagttactccacgcccccgccaccgtctgcggtcctaagaagtccaccaatctggttaagaacaaatgcgtgaacttcaacttcaacggcctgaccgggaccggcgtgctgaccgaaagcaacaaaaagttcctccccttccagcagttcggccgtgatatcgctgacaccacagatgccgtcagagatccacagaccctggaaatcctggatattacaccctgctccttcggaggagtttctgtgatcacccccgggaccaataccagcaaccaggtggctgtgctgtaccaagatgttaactgcaccgaggttcctgtggccatccacgccgatcagctgacacctacttggagagtgtactccactggctccaatgtgttccagaccagggccggatgtctgatcggcgccgagcacgtgaataacagttacgagtgcgacatccctatcggcgccggcatctgtgccagctaccagacccagacaaacagccctgggtctgcttcctctgtagctagccagagcatcatcgcctacaccatgagcctgggcgcagagaacagcgtggcctattccaacaactctatcgccattcccaccaactttacaattagcgtcacaacagagatcctgcccgtgagcatgaccaagaccagcgtggactgtacaatgtacatctgtggcgacagcactgaatgcagcaacctgctgctgcaatacggctccttttgcacccaactgaaccgggcgctgaccggaatcgccgtggaacaggacaaaaatacccaggaggtgttcgcccaagtgaagcagatctacaagaccccacctatcaaggacttcggcggctttaactttagccagattctccctgatccttctaagcctagcaagcggagctttatcgaggatctgctgttcaacaaggtcaccctggccgatgccggctttatcaaacagtatggcgattgcctgggcgacatagccgccagagatctgatctgcgcccagaaattcaacggcctgacagttctcccacctctgctgaccgacgagatgatcgctcagtacacctctgccctgctggctggcaccatcacatctgggtggacatttggcgccggcgccgccctgcagatcccctttgccatgcagatggcctatagattcaacggaatcggcgtgacccagaacgtgctgtatgaaaaccagaagctgatcgctaaccagttcaattctgccatcggcaagatccaggactccctctcctctaccgccagcgccctgggcaaactgcaggacgtggtgaatcagaacgcccaagccctgaacaccctggtgaagcagctcagcagcaattttggcgccatcagctctgtgctgaacgatatcctgtctagactggaccctccagaagccgaagtccagatcgatagactgatcacaggcagactgcagtccctgcaaacctacgtgacccaacagctgatcagggccgctgaaataagagccagcgccaatctcgccgctaccaagatgtccgagtgtgtgctgggacagtctaaacgcgttgacttctgcggcaaaggctatcacctgatgagcttcccccagagcgcgccgcacggcgtggtgttcctgcatgtgacatacgtgcctgcccaagagaagaatttcacaaccgcccctgccatctgccacgacggcaaggcccacttcccaagagagggcgttttcgtttccaatggcacacactggttcgtgacacaaagaaacttctacgaaccccagattatcaccaccgacaacaccttcgtgagtggcaattgtgacgtggtcatcggaatcgtgaacaacacagtgtacgaccctctgcaacctgagctggactcttttaaggaagagctggacaagtactttaaaaaccacaccagccccgatgtggacctgggcgacatcagtggcattaacgccagcgtggtgaacatccaaaaggaaatcgacagactgaacgaggtggccaagaacctgaacgagtccctgatcgacctgcaggagctcggcaaatacgagcagggatccggatacatccccgaggcccccagagatggccaggcctacgtgcggaaggacggcgagtgggtactgctgagcacattcctgggcagatccctggaggtgctgttccagggcccaggccatcaccaccatcaccaccatcatagcgcctggtcccacccccagttcgagaagggcggcggtagtggagggggcggatctggcggctcagcttggagccacccccagttcgaaaag

SEQ ID NO: 3-4 - skipped (2 entries)

SEQ ID NO: 5 - protein, 1273 aa, Severe acute respiratory syndrome coronavirus 2
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 6 - DNA, 3822 bp, Severe acute respiratory syndrome coronavirus 2
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 7-10 - skipped (4 entries)

SEQ ID NO: 11 - protein, 221 aa, Artificial Sequence
  Description of Artificial Sequence: Synthetic polypeptide
PPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12 - protein, 221 aa, Artificial Sequence
  Description of Artificial Sequence: Synthetic polypeptide
PPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13 - protein, 221 aa, Artificial Sequence
  Description of Artificial Sequence: Synthetic polypeptide
PPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHYTQKSLSLSPGK

SEQ ID NO: 14 - protein, 221 aa, Artificial Sequence
  Description of Artificial Sequence: Synthetic polypeptide
PPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 15 - protein, 221 aa, Artificial Sequence
  Description of Artificial Sequence: Synthetic polypeptide
PPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHYTRKELSLSPGK

SEQ ID NO: 16 - protein, 221 aa, Artificial Sequence
  Description of Artificial Sequence: Synthetic polypeptide
PPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17 - protein, 221 aa, Artificial Sequence
  Description of Artificial Sequence: Synthetic polypeptide
PPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18-20 - skipped (3 entries)

SEQ ID NO: 21 - protein, 457 aa, Artificial Sequence
  Description of Artificial Sequence: Synthetic polypeptide
QVQLVQSGAEVKKPGASVKVSCKASGYPFTSYGISWVRQAPGQGLEWMGWISTYNGNTNYAQKFQGRVTMTTDTSTTTGYMELRRLRSDDTAVYYCARDYTRGAWFGESLIGGFDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 22 - protein, 127 aa, Artificial Sequence [sequence omitted]

SEQ ID NO: 23-30 - skipped (8 entries)

SEQ ID NO: 31 - protein, 214 aa, Artificial Sequence
  Description of Artificial Sequence: Synthetic polypeptide
EIVLTQSPGTLSLSPGERATLSCRASQTVSSTSLAWYQQKPGQAPRLLIYGASSRATGIPDRFSGSGSGTDFTLTISRLEPEDFAVYYCQQHDTSLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32 - protein, 107 aa, Artificial Sequence [sequence omitted]

SEQ ID NO: 33-40 - skipped (8 entries)

SEQ ID NO: 41 - protein, 450 aa, Artificial Sequence
  Description of Artificial Sequence: Synthetic polypeptide
QVQLVESGGGVVQPGRSLRLSCAASGFTFSNYAMYWVRQAPGKGLEWVAVISYDGSNKYYADSVKGRFTISRDNSKNTLYLQMNSLRTEDTAVYYCASGSDYGDYLLVYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42 - protein, 120 aa, Artificial Sequence
  Description of Artificial Sequence: Synthetic polypeptide
QVQLVESGGGVVQPGRSLRLSCAASGFTFSNYAMYWVRQAPGKGLEWVAVISYDGSNKYYADSVKGRFTISRDNSKNTLYLQMNSLRTEDTAVYYCASGSDYGDYLLVYWGQGTLVTVSS

SEQ ID NO: 43-50 - skipped (8 entries)

SEQ ID NO: 51 - protein, 216 aa, Artificial Sequence
  Description of Artificial Sequence: Synthetic polypeptide
QSALTQPASVSGSPGQSITISCTGTSSDVGGYNYVSWYQQHPGKAPKLMIYDVSKRPSGVSNRFSGSKSGNTASLTISGLQSEDEADYYCNSLTSISTWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 52 - protein, 110 aa, Artificial Sequence
  Description of Artificial Sequence: Synthetic polypeptide
QSALTQPASVSGSPGQSITISCTGTSSDVGGYNYVSWYQQHPGKAPKLMIYDVSKRPSGVSNRFSGSKSGNTASLTISGLQSEDEADYYCNSLTSISTWVFGGGTKLTVL

SEQ ID NO: 53-60 - skipped (8 entries)

SEQ ID NO: 61 - protein, 450 aa, Artificial Sequence
  Description of Artificial Sequence: Synthetic polypeptide
QVQLVESGGGLVKPGGSLRLSCAASGFTFSDYYMSWIRQAPGKGLEWVSYITYSGSTIYYADSVKGRFTISRDNAKSSLYLQMNSLRAEDTAVYYCARDRGTTMVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 62 - protein, 120 aa, Artificial Sequence
  Description of Artificial Sequence: Synthetic polypeptide
QVQLVESGGGLVKPGGSLRLSCAASGFTFSDYYMSWIRQAPGKGLEWVSYITYSGSTIYYADSVKGRFTISRDNAKSSLYLQMNSLRAEDTAVYYCARDRGTTMVPFDYWGQGTLVTVSS

SEQ ID NO: 63-70 - skipped (8 entries)

SEQ ID NO: 71 - protein, 214 aa, Artificial Sequence
  Description of Artificial Sequence: Synthetic polypeptide
DIQMTQSPSSLSASVGDRVTITCQASQDITNYLNWYQQKPGKAPKLLIYAASNLETGVPSRFSGSGSGTDFTFTISGLQPEDIATYYCQQYDNLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 72 - protein, 107 aa, Artificial Sequence
  Description of Artificial Sequence: Synthetic polypeptide
DIQMTQSPSSLSASVGDRVTITCQASQDITNYLNWYQQKPGKAPKLLIYAASNLETGVPSRFSGSGSGTDFTFTISGLQPEDIATYYCQQYDNLPLTFGGGTKVEIK

SEQ ID NO: 73-80 - skipped (8 entries)

SEQ ID NO: 81 - protein, 449 aa, Artificial Sequence
  Description of Artificial Sequence: Synthetic polypeptide
EVQLVESGGGLVQPGGSLRLSCAASGFTVSSNYMSWVRQAPGKGLEWVSVIYSGGSTFYADSVKGRFTISRDNSMNTLFLQMNSLRAEDTAVYYCARVLPMYGDYLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 82 - protein, 119 aa, Artificial Sequence
  Description of Artificial Sequence: Synthetic polypeptide
EVQLVESGGGLVQPGGSLRLSCAASGFTVSSNYMSWVRQAPGKGLEWVSVIYSGGSTFYADSVKGRFTISRDNSMNTLFLQMNSLRAEDTAVYYCARVLPMYGDYLDYWGQGTLVTVSS

SEQ ID NO: 83-90 - skipped (8 entries)

SEQ ID NO: 91 - protein, 216 aa, Artificial Sequence
  Description of Artificial Sequence: Synthetic polypeptide
DIVMTQSPSSLSASVGDRVTITCRASQSISRYLNWYQQKPGKAPKLLIYAASSLQSGVPSRFSGSGSGTDFTLTISSLQPEDFATYYCQQSYSTPPEYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 92 - protein, 109 aa, Artificial Sequence
  Description of Artificial Sequence: Synthetic polypeptide
DIVMTQSPSSLSASVGDRVTITCRASQSISRYLNWYQQKPGKAPKLLIYAASSLQSGVPSRFSGSGSGTDFTLTISSLQPEDFATYYCQQSYSTPPEYTFGQGTKLEIK

SEQ ID NO: 93-101 - skipped (9 entries)

SEQ ID NO: 102 - protein, 124 aa, Artificial Sequence
  Description of Artificial Sequence: Synthetic polypeptide
EVQLVESGGGLVKPGGSLRLSCAASGFTFSSYYMNWVRQAPGKGLEWVSSISSDGYNTYYPDSLKGRFTISRDSAKNSLYLQMNSLRADDTAVYYCARDFSGHTAVAGTGFEYWGQGTLVTVSS

SEQ ID NO: 103 - protein, 26 aa, Artificial Sequence
  Description of Artificial Sequence: Synthetic peptide
EVQLVESGGGLVKPGGSLRLSCAASG

SEQ ID NO: 104 - protein, 9 aa, Artificial Sequence
  Description of Artificial Sequence: Synthetic peptide
FTFSSYYMN

SEQ ID NO: 105 - protein, 14 aa, Artificial Sequence
  Description of Artificial Sequence: Synthetic peptide
WVRQAPGKGLEWVS

SEQ ID NO: 106 - protein, 17 aa, Artificial Sequence
  Description of Artificial Sequence: Synthetic peptide
SISSDGYNTYYPDSLKG

SEQ ID NO: 107 - protein, 30 aa, Artificial Sequence
  Description of Artificial Sequence: Synthetic polypeptide
RFTISRDSAKNSLYLQMNSLRADDTAVYYC

SEQ ID NO: 108 - protein, 17 aa, Artificial Sequence
  Description of Artificial Sequence: Synthetic peptide
ARDFSGHTAVAGTGFEY

SEQ ID NO: 109 - protein, 11 aa, Artificial Sequence
  Description of Artificial Sequence: Synthetic peptide
WGQGTLVTVSS

SEQ ID NO: 110 - DNA, 372 bp, Artificial Sequence
  Description of Artificial Sequence: Synthetic polynucleotide
gaggtgcagctggtggagtctgggggaggcctggtcaagcctggggggtccctgagactctcctgtgcagcctctggattcacgtttagttcttattacatgaactgggtccgccaggctccagggaagggtctggagtgggtctcatccattagtagtgatggttataacacatactacccagactcactgaagggccgattcaccatctccagagacagcgccaagaactcactgtatctgcaaatgaacagcctgagagccgacgacacggctgtgtattattgtgcgagagatttttctgggcatacagcagtggctggtaccggtttcgaatactggggccagggaaccctggtcaccgtctcctca

SEQ ID NO: 111 - skipped

SEQ ID NO: 112 - protein, 112 aa, Artificial Sequence
  Description of Artificial Sequence: Synthetic polypeptide
QPVLTQPPSVSGAPGQRITISCTGSSSNIGAGYDVHWYQQLPGTAPKLLIYGSSSRPSGVPDRFSGSKSGTSASLAITGLQAEDEADYYCQSYDSSLSVLYVFGTGTKVTVL

SEQ ID NO: 113 - protein, 22 aa, Artificial Sequence
  Description of Artificial Sequence: Synthetic peptide
QPVLTQPPSVSGAPGQRITISC

SEQ ID NO: 114 - protein, 14 aa, Artificial Sequence
  Description of Artificial Sequence: Synthetic peptide
TGSSSNIGAGYDVH

SEQ ID NO: 115 - protein, 15 aa, Artificial Sequence
  Description of Artificial Sequence: Synthetic peptide
WYQQLPGTAPKLLIY

SEQ ID NO: 116 - protein, 7 aa, Artificial Sequence
  Description of Artificial Sequence: Synthetic peptide
GSSSRPS

SEQ ID NO: 117 - protein, 32 aa, Artificial Sequence
  Description of Artificial Sequence: Synthetic polypeptide
GVPDRFSGSKSGTSASLAITGLQAEDEADYYC

SEQ ID NO: 118 - protein, 12 aa, Artificial Sequence
  Description of Artificial Sequence: Synthetic peptide
QSYDSSLSVLYV

SEQ ID NO: 119 - protein, 10 aa, Artificial Sequence
  Description of Artificial Sequence: Synthetic peptide
FGTGTKVTVL

SEQ ID NO: 120 - DNA, 336 bp, Artificial Sequence
  Description of Artificial Sequence: Synthetic polynucleotide
cagcctgtgctgactcagccgccctcagtgtctggggccccagggcagaggatcaccatctcctgcactgggagcagctccaacatcggggcaggttatgatgtacactggtaccagcagcttccaggaacagcccccaaactcctcatctatggtagcagcagtcggccctcaggggtccctgaccgattctctggctccaagtctggcacctcagcctccctggccatcactgggctccaggctgaggatgaggctgattattactgccagtcctatgacagcagcctgagtgtcctttatgtcttcggaactgggaccaaggtcaccgtccta

SEQ ID NO: 121-201 - skipped (81 entries)

SEQ ID NO: 202 - protein, 121 aa, Artificial Sequence
  Description of Artificial Sequence: Synthetic polypeptide
QVQLVESGGGLVQPGGSLRLSCSASGFTFSRFAMHWVRQAPGKGLEYVSAINLNGDSTYYTDSVRGRFTISRDNSKNTLYLQMSSVRPDDTAFYYCVKDGGYYDSSGPGHWGQGTLVTVSS

SEQ ID NO: 203 - protein, 26 aa, Artificial Sequence
  Description of Artificial Sequence: Synthetic peptide
QVQLVESGGGLVQPGGSLRLSCSASG

SEQ ID NO: 204 - protein, 9 aa, Artificial Sequence
  Description of Artificial Sequence: Synthetic peptide
FTFSRFAMH

SEQ ID NO: 205 - protein, 14 aa, Artificial Sequence
  Description of Artificial Sequence: Synthetic peptide
WVRQAPGKGLEYVS

SEQ ID NO: 206 - protein, 17 aa, Artificial Sequence
  Description of Artificial Sequence: Synthetic peptide
AINLNGDSTYYTDSVRG

SEQ ID NO: 207 - protein, 30 aa, Artificial Sequence
  Description of Artificial Sequence: Synthetic polypeptide
RFTISRDNSKNTLYLQMSSVRPDDTAFYYC

SEQ ID NO: 208 - protein, 14 aa, Artificial Sequence
  Description of Artificial Sequence: Synthetic peptide
VKDGGYYDSSGPGH

SEQ ID NO: 209 - protein, 11 aa, Artificial Sequence
  Description of Artificial Sequence: Synthetic peptide
WGQGTLVTVSS

SEQ ID NO: 210 - DNA, 363 bp, Artificial Sequence
  Description of Artificial Sequence: Synthetic polynucleotide
caggtgcagctggtggaatctgggggaggcttggtccagcctggggggtccctgagactctcctgttcagcctctggattcaccttcagtagatttgctatgcactgggtccgccaggctccagggaagggactggaatatgtttcagctattaatctcaatggggatagcacatactacacagactccgtgaggggtagattcaccatctccagagacaactccaagaacacactgtatcttcaaatgagcagtgtgagacctgacgatacggctttttactactgtgtgaaagatgggggttactatgacagtagtggcccggggcactgggggcagggaaccctggtcaccgtctcctca

SEQ ID NO: 211 - skipped

SEQ ID NO: 212 - protein, 107 aa, Artificial Sequence
  Description of Artificial Sequence: Synthetic polypeptide
EIVLTQSPATLSLSPGERATLSCRASENIAHYLAWYQQKPGQAPRLVIYDASSRATGIPGRFSGSGAGTDFTLTINSLEPEDFAVYYCQQRSNWPQNFGGGTKVEIK

SEQ ID NO: 213 - protein, 23 aa, Artificial Sequence
  Description of Artificial Sequence: Synthetic peptide
EIVLTQSPATLSLSPGERATLSC

SEQ ID NO: 214 - protein, 11 aa, Artificial Sequence
  Description of Artificial Sequence: Synthetic peptide
RASENIAHYLA

SEQ ID NO: 215 - protein, 15 aa, Artificial Sequence
  Description of Artificial Sequence: Synthetic peptide
WYQQKPGQAPRLVIY

SEQ ID NO: 216 - protein, 7 aa, Artificial Sequence
  Description of Artificial Sequence: Synthetic peptide
DASSRAT

SEQ ID NO: 217 - protein, 32 aa, Artificial Sequence
  Description of Artificial Sequence: Synthetic polypeptide
GIPGRFSGSGAGTDFTLTINSLEPEDFAVYYC

SEQ ID NO: 218 - protein, 9 aa, Artificial Sequence
  Description of Artificial Sequence: Synthetic peptide
QQRSNWPQN

SEQ ID NO: 219 - protein, 10 aa, Artificial Sequence
  Description of Artificial Sequence: Synthetic peptide
FGGGTKVEIK

SEQ ID NO: 220 - DNA, 321 bp, Artificial Sequence
  Description of Artificial Sequence: Synthetic polynucleotide
gaaattgtattgacgcagtctcccgccaccctgtctttgtctccaggggaaagagccaccctctcctgcagggccagtgagaatattgcccactacttagcctggtaccaacagaaacctggccaggctcccaggctcgtcatctatgatgcatccagcagggccactggcatcccaggcaggttcagtggcagtggggctgggacagacttcactctcaccatcaacagcctagagcctgaagattttgcagtttattactgtcagcagcgtagtaactggcctcagaacttcggcggagggaccaaggtggaaatcaaa

SEQ ID NO: 221-301 - skipped (81 entries)

SEQ ID NO: 302 - protein, 123 aa, Artificial Sequence
  Description of Artificial Sequence: Synthetic polypeptide
QVQLQESGPGLVRPSETLSLTCTVSGDSVSSSDYHWGWIRQPPGKGLEWIGSIYYGGRSHFNPSLKSRVAIFVDTSNNQFSLRLNSVTASDTAVYFCAGRHQELLPMGSFDMWAQGTTVTVSS

SEQ ID NO: 303 - protein, 26 aa, Artificial Sequence
  Description of Artificial Sequence: Synthetic peptide
QVQLQESGPGLVRPSETLSLTCTVSG

SEQ ID NO: 304 - protein, 11 aa, Artificial Sequence
  Description of Artificial Sequence: Synthetic peptide
DSVSSSDYHWG

SEQ ID NO: 305 - protein, 14 aa, Artificial Sequence
  Description of Artificial Sequence: Synthetic peptide
WIRQPPGKGLEWIG

SEQ ID NO: 306 - protein, 16 aa, Artificial Sequence
  Description of Artificial Sequence: Synthetic peptide
SIYYGGRSHFNPSLKS

SEQ ID NO: 307 - protein, 30 aa, Artificial Sequence
  Description of Artificial Sequence: Synthetic polypeptide
RVAIFVDTSNNQFSLRLNSVTASDTAVYFC

SEQ ID NO: 308 - protein, 15 aa, Artificial Sequence
  Description of Artificial Sequence: Synthetic peptide
AGRHQELLPMGSFDM

SEQ ID NO: 309 - protein, 11 aa, Artificial Sequence
  Description of Artificial Sequence: Synthetic peptide
WAQGTTVTVSS

SEQ ID NO: 310 - DNA, 369 bp, Artificial Sequence
  Description of Artificial Sequence: Synthetic polynucleotide
caggtgcagctgcaggagtcgggcccagggctggtgaggccttcggagaccctgtccctcacctgcactgtctctggtgattccgtcagcagcagtgattaccactggggctggatccgccagcccccagggaaggggctggagtggattgggagtatttattatggtgggcgctcccacttcaacccgtccctcaagagtcgagtcgccatattcgttgacacgtccaacaatcaattctccctgagactgaattctgtgaccgcctcagacacggctgtgtatttctgtgcgggtcgccatcaggaactactgcctatgggttcttttgatatgtgggcccaagggaccacggtcaccgtctcctca

SEQ ID NO: 311 - skipped

SEQ ID NO: 312 - protein, 107 aa, Artificial Sequence
  Description of Artificial Sequence: Synthetic polypeptide
EIVMTQSPSSLSASIGDRVTISCRASQNIGSYLNWYQQRPGKAPNLLIFVASSLQSGVPSRFSGSGSGTDFTLTISSLQAEDFATYYCQQSYTTPITFGQGTRLEIK

SEQ ID NO: 313 - protein, 23 aa, Artificial Sequence
  Description of Artificial Sequence: Synthetic peptide
EIVMTQSPSSLSASIGDRVTISC

SEQ ID NO: 314 - protein, 11 aa, Artificial Sequence
  Description of Artificial Sequence: Synthetic peptide
RASQNIGSYLN

SEQ ID NO: 315 - protein, 15 aa, Artificial Sequence
  Description of Artificial Sequence: Synthetic peptide
WYQQRPGKAPNLLIF

SEQ ID NO: 316 - protein, 7 aa, Artificial Sequence
  Description of Artificial Sequence: Synthetic peptide
VASSLQS

SEQ ID NO: 317 - protein, 32 aa, Artificial Sequence
  Description of Artificial Sequence: Synthetic polypeptide
GVPSRFSGSGSGTDFTLTISSLQAEDFATYYC

SEQ ID NO: 318 - protein, 9 aa, Artificial Sequence
  Description of Artificial Sequence: Synthetic peptide
QQSYTTPIT

SEQ ID NO: 319 - protein, 10 aa, Artificial Sequence
  Description of Artificial Sequence: Synthetic peptide
FGQGTRLEIK

SEQ ID NO: 320 - DNA, 321 bp, Artificial Sequence
  Description of Artificial Sequence: Synthetic polynucleotide
gaaattgtgatgacgcagtctccatcgtccctgtccgcatctataggagacagagtcaccatcagttgccgggcaagtcagaacattggcagctatttaaattggtatcagcagagaccagggaaagcccctaacctcctgatatttgttgcatccagtttgcaaagtggggtcccgtccaggttcagtggcagtggatctgggacagatttcactctcaccatcagcagtctgcaagctgaagattttgcaacttactattgtcaacagagttacactaccccgatcaccttcggccaagggacacgactggagattaaa

SEQ ID NO: 321-401 - skipped (81 entries)

SEQ ID NO: 402 - protein, 123 aa, Artificial Sequence
  Description of Artificial Sequence: Synthetic polypeptide
EVQLVESGGGLVKPGGSLRLSCAASGFTFSDYYMNWVRQAPGKGLEWVSSISSSSYMYYADSMKGRFTISRDNAQNSLYLQMSSLRAEDTAVYYCARDFPGDTAVAGTGFNYWGQGTLVTVSS

SEQ ID NO: 403 - protein, 26 aa, Artificial Sequence
  Description of Artificial Sequence: Synthetic peptide
EVQLVESGGGLVKPGGSLRLSCAASG

SEQ ID NO: 404 - protein, 9 aa, Artificial Sequence
  Description of Artificial Sequence: Synthetic peptide
FTFSDYYMN

SEQ ID NO: 405 - protein, 14 aa, Artificial Sequence
  Description of Artificial Sequence: Synthetic peptide
WVRQAPGKGLEWVS

SEQ ID NO: 406 - protein, 16 aa, Artificial Sequence
  Description of Artificial Sequence: Synthetic peptide
SISSSSYMYYADSMKG

SEQ ID NO: 407 - protein, 30 aa, Artificial Sequence
  Description of Artificial Sequence: Synthetic polypeptide
RFTISRDNAQNSLYLQMSSLRAEDTAVYYC

SEQ ID NO: 408 - protein, 17 aa, Artificial Sequence
  Description of Artificial Sequence: Synthetic peptide
ARDFPGDTAVAGTGFNY

SEQ ID NO: 409 - protein, 11 aa, Artificial Sequence
  Description of Artificial Sequence: Synthetic peptide
WGQGTLVTVSS

SEQ ID NO: 410 - DNA, 369 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtgactattacatgaactgggtccgccaggctccagggaaggggctggagtgggtctcatccattagtagtagtagttacatgtactacgcagactcaatgaagggccgattcaccatctccagagacaacgcccagaactcactgtatctgcaaatgagcagcctgagagccgaggacacggctgtgtattactgtgcgagagattttcctggggatacagcagtggctggcaccggtttcaattattggggccagggaaccctggtcaccgtctcctca

SEQ ID NO: 411 - skipped

SEQ ID NO: 412 - protein, 112 aa, Artificial Sequence
  Description of Artificial Sequence: Synthetic polypeptide
QSVLTQPPSVSGAPGQRVTISCTGSSSNIGAGYDVHWYQQVPGTAPKLLIYGNSNRPSGVPDRFSGSKSGTSASLAITGLQAEDEADYYCQSYDSSLSVLYVFGTGTKVTVL

SEQ ID NO: 413 - protein, 22 aa, Artificial Sequence
  Description of Artificial Sequence: Synthetic peptide
QSVLTQPPSVSGAPGQRVTISC

SEQ ID NO: 414 - protein, 14 aa, Artificial Sequence
  Description of Artificial Sequence: Synthetic peptide
TGSSSNIGAGYDVH

SEQ ID NO: 415 - protein, 15 aa, Artificial Sequence
  Description of Artificial Sequence: Synthetic peptide
WYQQVPGTAPKLLIY

SEQ ID NO: 416 - protein, 7 aa, Artificial Sequence
  Description of Artificial Sequence: Synthetic peptide
GNSNRPS

SEQ ID NO: 417 - protein, 32 aa, Artificial Sequence; identical to SEQ ID NO: 117
  Description of Artificial Sequence: Synthetic polypeptide

SEQ ID NO: 418 - protein, 12 aa, Artificial Sequence
  Description of Artificial Sequence: Synthetic peptide
QSYDSSLSVLYV

SEQ ID NO: 419 - protein, 10 aa, Artificial Sequence
  Description of Artificial Sequence: Synthetic peptide
FGTGTKVTVL

SEQ ID NO: 420 - DNA, 336 bp, Artificial Sequence
  Description of Artificial Sequence: Synthetic polynucleotide
cagtctgtgctgacgcagccgccctcagtgtctggggccccagggcagagggtcaccatctcctgcactgggagcagctccaacatcggggcaggttatgatgtacactggtaccagcaggttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtgtcctttatgtcttcggaactgggaccaaggtcaccgtccta

SEQ ID NO: 421-501 - skipped (81 entries)

SEQ ID NO: 502 - protein, 126 aa, Artificial Sequence
  Description of Artificial Sequence: Synthetic polypeptide
EVQLVESGGGLVQPGRSLRLSCSASGFSFGDYAMSWFRQAPGKGLQWVGLIKTRAYGAATDYAASVQGRFIISRDDSKSIAYLQMNSLKTEDTAVYFCAREGTSLGYYYYYAMDVWGHGTTVTVSS

SEQ ID NO: 503 - protein, 26 aa, Artificial Sequence
  Description of Artificial Sequence: Synthetic peptide
EVQLVESGGGLVQPGRSLRLSCSASG

SEQ ID NO: 504 - protein, 9 aa, Artificial Sequence
  Description of Artificial Sequence: Synthetic peptide
FSFGDYAMS

SEQ ID NO: 505 - protein, 14 aa, Artificial Sequence
  Description of Artificial Sequence: Synthetic peptide
WFRQAPGKGLQWVG

SEQ ID NO: 506 - protein, 19 aa, Artificial Sequence
  Description of Artificial Sequence: Synthetic peptide
LIKTRAYGAATDYAASVQG

SEQ ID NO: 507 - protein, 30 aa, Artificial Sequence
  Description of Artificial Sequence: Synthetic polypeptide
RFIISRDDSKSIAYLQMNSLKTEDTAVYFC

SEQ ID NO: 508 - protein, 17 aa, Artificial Sequence
  Description of Artificial Sequence: Synthetic peptide
AREGTSLGYYYYYAMDV

SEQ ID NO: 509 - protein, 11 aa, Artificial Sequence
  Description of Artificial Sequence: Synthetic peptide
WGHGTTVTVSS

SEQ ID NO: 510 - DNA, 378 bp, Artificial Sequence
  Description of Artificial Sequence: Synthetic polynucleotide
gaggtgcagctggtggagtctgggggaggcttggtacagccagggcggtccctgagactctcctgttcagcttctggattctcctttggtgattatgccatgagttggttccgccaggctccagggaaggggctgcagtgggtcgggctcattaaaaccagagcttatggtgcggcaacagactacgccgcgtctgtgcaaggcagattcatcatctcaagagatgattccaagagcatcgcctatctccaaatgaacagcctgaaaaccgaggacacagccgtgtatttctgtgctagagagggaacctcgctgggttactattattactacgcaatggacgtctggggccacgggaccacggtcaccgtctcctca

SEQ ID NO: 511 - skipped

SEQ ID NO: 512 - protein, 107 aa, Artificial Sequence
  Description of Artificial Sequence: Synthetic polypeptide
DIVLTQTPSSLSASVGDRVTITCRASQTISYYLNWYQQKVGKAPQLLVYAASSLQSGVPSRFSGSGSGTDFTLTISSLQPEDFATYYCQQSYSVPLTLGQGTKVDIK

SEQ ID NO: 513 - protein, 23 aa, Artificial Sequence
  Description of Artificial Sequence: Synthetic peptide
DIVLTQTPSSLSASVGDRVTITC

SEQ ID NO: 514 - protein, 11 aa, Artificial Sequence
  Description of Artificial Sequence: Synthetic peptide
RASQTISYYLN

SEQ ID NO: 515 - protein, 15 aa, Artificial Sequence
  Description of Artificial Sequence: Synthetic peptide
WYQQKVGKAPQLLVY

SEQ ID NO: 516 - protein, 7 aa, Artificial Sequence
  Description of Artificial Sequence: Synthetic peptide
AASSLQS

SEQ ID NO: 517 - protein, 32 aa, Artificial Sequence
  Description of Artificial Sequence: Synthetic polypeptide
GVPSRFSGSGSGTDFTLTISSLQPEDFATYYC

SEQ ID NO: 518 - protein, 9 aa, Artificial Sequence
  Description of Artificial Sequence: Synthetic peptide
QQSYSVPLT

SEQ ID NO: 519 - protein, 10 aa, Artificial Sequence
  Description of Artificial Sequence: Synthetic peptide
LGQGTKVDIK

SEQ ID NO: 520 - DNA, 321 bp, Artificial Sequence
  Description of Artificial Sequence: Synthetic polynucleotide
gatattgtgctgactcagactccatcctccctgtctgcgtctgtaggagacagagtcaccatcacttgccgggcaagtcagactattagttattatttaaattggtaccagcagaaagtagggaaagcccctcagctcctggtctatgctgcttccagtttgcaaagtggggtcccatcacggttcagtggcagtggatctgggacagatttcactctcaccatcagcagtctgcaacctgaagattttgcaacctactactgtcaacagagttacagtgttcctctgacgctcggccaagggaccaaagtggatatcaaa

SEQ ID NO: 521-601 - skipped (81 entries)

SEQ ID NO: 602 - protein, 123 aa, Artificial Sequence; identical to SEQ ID NO: 402
  Description of Artificial Sequence: Synthetic polypeptide

SEQ ID NO: 603 - protein, 26 aa, Artificial Sequence
  Description of Artificial Sequence: Synthetic peptide
EVQLVESGGGLVKPGGSLRLSCAASG

SEQ ID NO: 604 - protein, 9 aa, Artificial Sequence
  Description of Artificial Sequence: Synthetic peptide
FTFSDYYMN

SEQ ID NO: 605 - protein, 14 aa, Artificial Sequence
  Description of Artificial Sequence: Synthetic peptide
WVRQAPGKGLEWVS

SEQ ID NO: 606 - protein, 16 aa, Artificial Sequence
  Description of Artificial Sequence: Synthetic peptide
SISSSSYMYYADSMKG

SEQ ID NO: 607 - protein, 30 aa, Artificial Sequence; identical to SEQ ID NO: 407
  Description of Artificial Sequence: Synthetic polypeptide

SEQ ID NO: 608 - protein, 17 aa, Artificial Sequence
  Description of Artificial Sequence: Synthetic peptide
ARDFPGDTAVAGTGFNY

SEQ ID NO: 609 - protein, 11 aa, Artificial Sequence
  Description of Artificial Sequence: Synthetic peptide
WGQGTLVTVSS

SEQ ID NO: 610 - DNA, 369 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtgactattacatgaactgggtccgccaggctccagggaaggggctggagtgggtctcatccattagtagtagtagttacatgtactacgcagactcaatgaagggccgattcaccatctccagagacaacgcccagaactcactgtatctgcaaatgagcagcctgagagccgaggacacggctgtgtattactgtgcgagagattttcctggggatacagcagtggctggcaccggtttcaattattggggccagggaaccctggtcactgtctcctca

SEQ ID NO: 611 - skipped

SEQ ID NO: 612 - protein, 112 aa, Artificial Sequence
  Description of Artificial Sequence: Synthetic polypeptide
QPVLTQPPSVSGAPGQRVTISCTGSSSNIGAGYDVHWYRQVPGTAPKLLIYGNSNRPSGVPDRFSGSKSGTSASLAITGLQAEDEADYYCQSYDSSLSVLYVFGTGTKLTVL

SEQ ID NO: 613 - protein, 22 aa, Artificial Sequence
  Description of Artificial Sequence: Synthetic peptide
QPVLTQPPSVSGAPGQRVTISC

SEQ ID NO: 614 - protein, 14 aa, Artificial Sequence
  Description of Artificial Sequence: Synthetic peptide
TGSSSNIGAGYDVH

SEQ ID NO: 615 - protein, 15 aa, Artificial Sequence
  Description of Artificial Sequence: Synthetic peptide
WYRQVPGTAPKLLIY

SEQ ID NO: 616 - protein, 7 aa, Artificial Sequence
  Description of Artificial Sequence: Synthetic peptide
GNSNRPS

SEQ ID NO: 617 - protein, 32 aa, Artificial Sequence; identical to SEQ ID NO: 117
  Description of Artificial Sequence: Synthetic polypeptide

SEQ ID NO: 618 - protein, 12 aa, Artificial Sequence
  Description of Artificial Sequence: Synthetic peptide
QSYDSSLSVLYV

SEQ ID NO: 619 - protein, 10 aa, Artificial Sequence
  Description of Artificial Sequence: Synthetic peptide
FGTGTKLTVL

SEQ ID NO: 620 - DNA, 336 bp, Artificial Sequence
  Description of Artificial Sequence: Synthetic polynucleotide
cagccagtgctgactcagccgccctcagtgtctggggccccagggcagagggtcaccatctcctgcactgggagcagctccaacatcggggcaggttatgatgtacactggtaccggcaggttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtgtcctttatgtcttcggaactgggaccaagctgaccgtccta

SEQ ID NO: 621-701 - skipped (81 entries)

SEQ ID NO: 702 - protein, 125 aa, Artificial Sequence
  Description of Artificial Sequence: Synthetic polypeptide
QVQLVQSGAEVKKPGASVKVSCRASGYTFSGYDINWVRQATGQGLEWMGWMNPNSGDTGYAHKFQGRVTMTRNSSISTAYMELSSLTSEDTAVYFCAREKKSFGPQYYYGSGEDWGQGTLVTVSS

SEQ ID NO: 703 - protein, 26 aa, Artificial Sequence
  Description of Artificial Sequence: Synthetic peptide
QVQLVQSGAEVKKPGASVKVSCRASG

SEQ ID NO: 704 - protein, 9 aa, Artificial Sequence
  Description of Artificial Sequence: Synthetic peptide
YTFSGYDIN

SEQ ID NO: 705 - protein, 14 aa, Artificial Sequence
  Description of Artificial Sequence: Synthetic peptide
WVRQATGQGLEWMG

SEQ ID NO: 706 - protein, 17 aa, Artificial Sequence
  Description of Artificial Sequence: Synthetic peptide
WMNPNSGDTGYAHKFQG

SEQ ID NO: 707 - protein, 30 aa, Artificial Sequence
  Description of Artificial Sequence: Synthetic polypeptide
RVTMTRNSSISTAYMELSSLTSEDTAVYFC

SEQ ID NO: 708 - protein, 18 aa, Artificial Sequence
  Description of Artificial Sequence: Synthetic peptide
AREKKSFGPQYYYGSGED

SEQ ID NO: 709 - protein, 11 aa, Artificial Sequence
  Description of Artificial Sequence: Synthetic peptide
WGQGTLVTVSS

SEQ ID NO: 710 - DNA, 375 bp, Artificial Sequence
  Description of Artificial Sequence: Synthetic polynucleotide
caggtccagctggtacagtctggggctgaggtgaagaagcctggggcctcagtgaaggtctcctgcagggcttctggatacaccttcagcggttatgatatcaactgggtgcgacaggccactggacaagggcttgagtggatgggatggatgaaccctaacagtggtgacacaggctatgcacataagttccagggcagagtcaccatgaccaggaactcctccataagcacagcctacatggagctgagcagcctgacatctgaggacacggccgtgtatttctgtgcgagagagaaaaagtcatttgggcctcaatactactatggttcgggagaggactggggccagggaaccctggtcaccgtctcttca

SEQ ID NO: 711 - skipped

SEQ ID NO: 712 - protein, 107 aa, Artificial Sequence
  Description of Artificial Sequence: Synthetic polypeptide
EIVMTQSPSSLSASVGDRVTITCRASQSISNYLYWYQQKPGKAPKLLIYVASNLQSGVPSRFSGSGSGTDFTLTISSLQPEDFATYYCQQSYSTPYNFGQGTKVDIK

SEQ ID NO: 713 - protein, 23 aa, Artificial Sequence
  Description of Artificial Sequence: Synthetic peptide
EIVMTQSPSSLSASVGDRVTITC

SEQ ID NO: 714 - protein, 11 aa, Artificial Sequence
  Description of Artificial Sequence: Synthetic peptide
RASQSISNYLY

SEQ ID NO: 715 - protein, 15 aa, Artificial Sequence
  Description of Artificial Sequence: Synthetic peptide
WYQQKPGKAPKLLIY

SEQ ID NO: 716 - protein, 7 aa, Artificial Sequence
  Description of Artificial Sequence: Synthetic peptide
VASNLQS

SEQ ID NO: 717 - protein, 32 aa, Artificial Sequence; identical to SEQ ID NO: 517
  Description of Artificial Sequence: Synthetic polypeptide

SEQ ID NO: 718 - protein, 9 aa, Artificial Sequence
  Description of Artificial Sequence: Synthetic peptide
QQSYSTPYN

SEQ ID NO: 719 - protein, 10 aa, Artificial Sequence
  Description of Artificial Sequence: Synthetic peptide
FGQGTKVDIK

SEQ ID NO: 720 - DNA, 321 bp, Artificial Sequence
  Description of Artificial Sequence: Synthetic polynucleotide
gaaattgtgatgacgcagtctccatcctccctgtctgcgtctgtcggagacagggtcacaatcacttgccgggcgagtcagagcattagcaactatttatattggtatcaacagaaaccagggaaagcccctaagctcctgatctatgttgcatccaatttgcagagtggggtcccatcaaggttcagtggcagtggatctgggacagatttcactctcaccatcagcagtctgcaacctgaagattttgcaacttactactgtcaacagagttacagtaccccgtacaattttggccaggggaccaaagtggatatcaaa

SEQ ID NO: 721-801 - skipped (81 entries)

SEQ ID NO: 802 - protein, 123 aa, Artificial Sequence
  Description of Artificial Sequence: Synthetic polypeptide
EVQLLESGGGLSRPGGSLRLSCAASGFIASRNCMQWVRQAPGKGLEWVSIICGDEITYIRDSVKGRFTISRDDSKNTLHLEMNSLRADDTAVYYCARATPPGGTTGWPYIDLWGQGTLVTVSS

SEQ ID NO: 803 - protein, 26 aa, Artificial Sequence
  Description of Artificial Sequence: Synthetic peptide
EVQLLESGGGLSRPGGSLRLSCAASG

SEQ ID NO: 804 - protein, 9 aa, Artificial Sequence
  Description of Artificial Sequence: Synthetic peptide
FIASRNCMQ

SEQ ID NO: 805 - protein, 14 aa, Artificial Sequence
  Description of Artificial Sequence: Synthetic peptide
WVRQAPGKGLEWVS

SEQ ID NO: 806 - protein, 16 aa, Artificial Sequence
  Description of Artificial Sequence: Synthetic peptide
IICGDEITYIRDSVKG

SEQ ID NO: 807 - protein, 30 aa, Artificial Sequence
  Description of Artificial Sequence: Synthetic polypeptide
RFTISRDDSKNTLHLEMNSLRADDTAVYYC

SEQ ID NO: 808 - protein, 17 aa, Artificial Sequence
  Description of Artificial Sequence: Synthetic peptide
ARATPPGGTTGWPYIDL

SEQ ID NO: 809 - protein, 11 aa, Artificial Sequence
  Description of Artificial Sequence: Synthetic peptide
WGQGTLVTVSS

SEQ ID NO: 810 - DNA, 369 bp, Artificial Sequence
  Description of Artificial Sequence: Synthetic polynucleotide
gaggtgcagctgttggagtccggaggaggcttgagccggccgggggggtctctaagactctcctgtgcggcctctgggttcatcgccagtaggaactgcatgcagtgggtccgccaggccccagggaaggggctggagtgggtctcaattatttgcggcgatgagatcacgtatatccgcgactccgtgaagggccggttcaccatctccagagacgattctaagaacacactgcatcttgaaatgaacagcctcagagccgacgacacggccgtctattactgtgcgagagcgacacccccggggggtactactggctggccctacattgatctctggggccagggaaccctggtcaccgtctcctca

SEQ ID NO: 811 - skipped

SEQ ID NO: 812 - protein, 108 aa, Artificial Sequence
  Description of Artificial Sequence: Synthetic polypeptide
EIVLTQSPATLSVSPGDGASLSCRASQSVGSNLAWYQQKPGQAPRLLISDASARATGVPARFTGSGSGTDFTLTISSLQSEDFAVYYCHQYNTWPPLTFGGGTKLEIK

SEQ ID NO: 813 - protein, 23 aa, Artificial Sequence
  Description of Artificial Sequence: Synthetic peptide
EIVLTQSPATLSVSPGDGASLSC

SEQ ID NO: 814 - protein, 11 aa, Artificial Sequence
  Description of Artificial Sequence: Synthetic peptide
RASQSVGSNLA

SEQ ID NO: 815 - protein, 15 aa, Artificial Sequence
  Description of Artificial Sequence: Synthetic peptide
WYQQKPGQAPRLLIS

SEQ ID NO: 816 - protein, 7 aa, Artificial Sequence
  Description of Artificial Sequence: Synthetic peptide
DASARAT

SEQ ID NO: 817 - protein, 32 aa, Artificial Sequence
  Description of Artificial Sequence: Synthetic polypeptide
GVPARFTGSGSGTDFTLTISSLQSEDFAVYYC

SEQ ID NO: 818 - protein, 10 aa, Artificial Sequence
  Description of Artificial Sequence: Synthetic peptide
HQYNTWPPLT

SEQ ID NO: 819 - protein, 10 aa, Artificial Sequence
  Description of Artificial Sequence: Synthetic peptide
FGGGTKLEIK

SEQ ID NO: 820 - DNA, 324 bp, Artificial Sequence
  Description of Artificial Sequence: Synthetic polynucleotide
gaaattgtgttgacgcagtctccagccactctgtctgtgtctccaggggatggagcctccctctcctgcagggccagtcagagtgttggcagcaacttagcctggtaccagcagaaacctggccaggctcccaggctcctcatctctgatgcatccgccagggccactggtgtcccagccaggtttactggcagtgggtctgggacagacttcactctcaccatcagcagcctgcagtctgaagattttgcagtttattactgtcaccaatataatacctggcctcctctcactttcggcggagggaccaagctggagatcaaa

SEQ ID NO: 821-901 - skipped (81 entries)

SEQ ID NO: 902 - protein, 125 aa, Artificial Sequence
  Description of Artificial Sequence: Synthetic polypeptide
QVQLVQSGAEVKKPGSSMKLSCKASGINFRSYSFSWVRQAPGQGLEWMGGVIPYFPTANYAEKFRGRVTATADESTGTVYLEMSSLRSEDTAVYYCASEYFDGRSYHSFCGLDVWGQGTLVTVSS

SEQ ID NO: 903 - protein, 26 aa, Artificial Sequence
  Description of Artificial Sequence: Synthetic peptide
QVQLVQSGAEVKKPGSSMKLSCKASG

SEQ ID NO: 904 - protein, 9 aa, Artificial Sequence
  Description of Artificial Sequence: Synthetic peptide
INFRSYSFS

SEQ ID NO: 905 - protein, 14 aa, Artificial Sequence
  Description of Artificial Sequence: Synthetic peptide
WVRQAPGQGLEWMG

SEQ ID NO: 906 - protein, 17 aa, Artificial Sequence
  Description of Artificial Sequence: Synthetic peptide
GVIPYFPTANYAEKFRG

SEQ ID NO: 907 - protein, 30 aa, Artificial Sequence
  Description of Artificial Sequence: Synthetic polypeptide
RVTATADESTGTVYLEMSSLRSEDTAVYYC

SEQ ID NO: 908 - protein, 18 aa, Artificial Sequence
  Description of Artificial Sequence: Synthetic peptide
ASEYFDGRSYHSFCGLDV

SEQ ID NO: 909 - protein, 11 aa, Artificial Sequence
  Description of Artificial Sequence: Synthetic peptide
WGQGTLVTVSS

SEQ ID NO: 910 - DNA, 375 bp, Artificial Sequence
  Description of Artificial Sequence: Synthetic polynucleotide
caggtccagcttgtacagtctggggctgaggtgaagaagcctgggtcttcgatgaagctctcctgcaaggcttctgggatcaactttaggagttattctttcagctgggtgcgacaggcccctggacaaggacttgagtggatgggcggcgtcatcccttactttccgacagcgaactacgcagagaaattccggggcagggtcacggctaccgcggacgagtccacgggcacagtgtacttggagatgagcagcctgcgatctgaagacacggccgtctactattgtgcgagcgagtactttgatggtcgttcttaccactccttctgcggcttggacgtctggggccaagggaccctggtcaccgtctcctca

SEQ ID NO: 911 - skipped

SEQ ID NO: 912 - protein, 112 aa, Artificial Sequence
  Description of Artificial Sequence: Synthetic polypeptide
ETTLTQSPLSLPVTLGQPASISCRSSQGLAHSNGNTYLNWFHQRPGQSPRRLIYQVSNRDSGVPDRFSGSGSGTDFTLKISRVEAEDVGVYYCMQGTEWPRTFGQGTKVEIK

SEQ ID NO: 913 - protein, 23 aa, Artificial Sequence
  Description of Artificial Sequence: Synthetic peptide
ETTLTQSPLSLPVTLGQPASISC

SEQ ID NO: 914 - protein, 16 aa, Artificial Sequence
  Description of Artificial Sequence: Synthetic peptide
RSSQGLAHSNGNTYLN

SEQ ID NO: 915 - protein, 15 aa, Artificial Sequence
  Description of Artificial Sequence: Synthetic peptide
WFHQRPGQSPRRLIY

SEQ ID NO: 916 - protein, 7 aa, Artificial Sequence
  Description of Artificial Sequence: Synthetic peptide
QVSNRDS

SEQ ID NO: 917 - protein, 32 aa, Artificial Sequence
  Description of Artificial Sequence: Synthetic polypeptide
GVPDRFSGSGSGTDFTLKISRVEAEDVGVYYC

SEQ ID NO: 918 - protein, 9 aa, Artificial Sequence
  Description of Artificial Sequence: Synthetic peptide
MQGTEWPRT

SEQ ID NO: 919 - protein, 10 aa, Artificial Sequence
  Description of Artificial Sequence: Synthetic peptide
FGQGTKVEIK

SEQ ID NO: 920 - DNA, 336 bp, Artificial Sequence
  Description of Artificial Sequence: Synthetic polynucleotide
gaaacgacactcacgcagtctccactctctctgcccgtcacccttggacagccggcctccatctcctgcaggtctagtcaaggcctcgcacacagtaatggaaacacctacttgaattggtttcaccagaggccaggccaatctccaaggcgcctaatttatcaagtttctaatcgggactctggggtcccagacagattcagcggcagtgggtcaggcactgatttcacactgaaaataagcagggtggaggctgaggatgttggggtttattactgcatgcaaggcacagaatggcctcggacgttcggccaagggaccaaggtggaaatcaaa

SEQ ID NO: 921-1001 - skipped (81 entries)

SEQ ID NO: 1002 - protein, 124 aa, Artificial Sequence
  Description of Artificial Sequence: Synthetic polypeptide
QVQLVQSGAEVKKPGASVKVSCKASGYTFSSYDINWVRQATGQGLEWMGWMSPNTGDTGYAHKFQGRVRMTSNTSISTAYMELNSLTSEDTAVYYCARRGNNFGYYYYYTVDVWGQGTTVTVSS

SEQ ID NO: 1003 - protein, 26 aa, Artificial Sequence
  Description of Artificial Sequence: Synthetic peptide
QVQLVQSGAEVKKPGASVKVSCKASG

SEQ ID NO: 1004 - protein, 9 aa, Artificial Sequence
  Description of Artificial Sequence: Synthetic peptide
YTFSSYDIN

SEQ ID NO: 1005 - protein, 14 aa, Artificial Sequence
  Description of Artificial Sequence: Synthetic peptide
WVRQATGQGLEWMG

SEQ ID NO: 1006 - protein, 17 aa, Artificial Sequence
  Description of Artificial Sequence: Synthetic peptide
WMSPNTGDTGYAHKFQG

SEQ ID NO: 1007 - protein, 30 aa, Artificial Sequence
  Description of Artificial Sequence: Synthetic polypeptide
RVRMTSNTSISTAYMELNSLTSEDTAVYYC

SEQ ID NO: 1008 - protein, 17 aa, Artificial Sequence
  Description of Artificial Sequence: Synthetic peptide
ARRGNNFGYYYYYTVDV

SEQ ID NO: 1009 - protein, 11 aa, Artificial Sequence
  Description of Artificial Sequence: Synthetic peptide
WGQGTTVTVSS

SEQ ID NO: 1010 - DNA, 372 bp, Artificial Sequence
  Description of Artificial Sequence: Synthetic polynucleotide
caggtccagctggtacagtctggggctgaggtgaagaagcctggggcctcagtgaaggtctcctgcaaggcttctggctacaccttcagcagttatgatatcaattgggtgcgacaggccactggacaagggcttgagtggatgggatggatgagccctaacaccggtgacacaggctatgcacacaaatttcagggcagagtccgcatgaccagcaacacctccataagcacagcctacatggagctgaacagcctgacatctgaagacacggccgtatattactgtgcgagacgtggaaataactttgggtattattattactacactgtggacgtctggggccaagggaccacggtcaccgtctcctca

SEQ ID NO: 1011 - skipped

SEQ ID NO: 1012 - protein, 107 aa, Artificial Sequence
  Description of Artificial Sequence: Synthetic polypeptide
DIRLTQSPSSLSASVGDRVTIACRASQSVSNYLNWYQQKPGKAPKLLIYAASSLQNGVPSRFGGSGSGTDFTLTISSLQPEDFATYYCQQCYSYPPTFGHGTKVEIK

SEQ ID NO: 1013 - protein, 23 aa, Artificial Sequence
  Description of Artificial Sequence: Synthetic peptide
DIRLTQSPSSLSASVGDRVTIAC

SEQ ID NO: 1014 - protein, 11 aa, Artificial Sequence
  Description of Artificial Sequence: Synthetic peptide
RASQSVSNYLN

SEQ ID NO: 1015 - protein, 15 aa, Artificial Sequence
  Description of Artificial Sequence: Synthetic peptide
WYQQKPGKAPKLLIY

SEQ ID NO: 1016 - protein, 7 aa, Artificial Sequence
  Description of Artificial Sequence: Synthetic peptide
AASSLQN

SEQ ID NO: 1017 - protein, 32 aa, Artificial Sequence
  Description of Artificial Sequence: Synthetic polypeptide
GVPSRFGGSGSGTDFTLTISSLQPEDFATYYC

SEQ ID NO: 1018 - protein, 9 aa, Artificial Sequence
  Description of Artificial Sequence: Synthetic peptide
QQCYSYPPT

SEQ ID NO: 1019 - protein, 10 aa, Artificial Sequence
  Description of Artificial Sequence: Synthetic peptide
FGHGTKVEIK

SEQ ID NO: 1020 - DNA, 321 bp, Artificial Sequence
  Description of Artificial Sequence: Synthetic polynucleotide
gacatccggttgacccagtctccatcctccctgtcagcatctgtaggagaccgagtcaccatcgcttgccgggcaagtcagagtgttagtaattatttaaactggtatcagcagaaaccagggaaagcccctaagctcctgatctatgctgcatccagtttgcaaaatggggtcccatcaaggttcggtggcagtggatctgggacagacttcactctcaccatcagcagtctgcaacctgaagattttgcaacttactactgtcaacagtgttacagttaccctccgacgttcggccacgggaccaaggtggaaatcaaa

SEQ ID NO: 1021-1101 - skipped (81 entries)

SEQ ID NO: 1102 - protein, 123 aa, Artificial Sequence
  Description of Artificial Sequence: Synthetic polypeptide
EVQLVESGGGLSQPGGSLRLSCAASGFVVKNNCMNWVRQAPGKGLEWVALICADGITYHSDSVTGRFTIYRDESDNTLHLQMDSLRIEDTAVYYCVRASPPGGNTGWPFFEDWGQGTLVTVSS

SEQ ID NO: 1103 - protein, 26 aa, Artificial Sequence
  Description of Artificial Sequence: Synthetic peptide
EVQLVESGGGLSQPGGSLRLSCAASG

SEQ ID NO: 1104 - protein, 9 aa, Artificial Sequence
  Description of Artificial Sequence: Synthetic peptide
FVVKNNCMN

SEQ ID NO: 1105 - protein, 14 aa, Artificial Sequence
  Description of Artificial Sequence: Synthetic peptide
WVRQAPGKGLEWVA

SEQ ID NO: 1106 - protein, 16 aa, Artificial Sequence
  Description of Artificial Sequence: Synthetic peptide
LICADGITYHSDSVTG

SEQ ID NO: 1107 - protein, 30 aa, Artificial Sequence
  Description of Artificial Sequence: Synthetic polypeptide
RFTIYRDESDNTLHLQMDSLRIEDTAVYYC

SEQ ID NO: 1108 - protein, 17 aa, Artificial Sequence
  Description of Artificial Sequence: Synthetic peptide
VRASPPGGNTGWPFFED

SEQ ID NO: 1109 - protein, 11 aa, Artificial Sequence
  Description of Artificial Sequence: Synthetic peptide
WGQGTLVTVSS

SEQ ID NO: 1110 - DNA, 369 bp, Artificial Sequence
  Description of Artificial Sequence: Synthetic polynucleotide
gaggtgcagctggtggagtccggagggggcttgagccagcctggggggtccctgaggctctcctgtgcagcctctggtttcgtcgtcaaaaacaattgcatgaactgggtccgtcaggctccagggaaggggctggagtgggtcgcacttatttgtgccgatgggatcacataccactcagactccgtgacgggccgattcaccatctacagagacgaatctgacaatacactgcatcttcaaatggacagcctcagaatcgaggacacggccgtctattattgtgtgagagcgtcgccccccgggggcaacactggctggcccttctttgaagactggggccagggcaccctggtcaccgtctcctca

SEQ ID NO: 1111 - skipped

SEQ ID NO: 1112 - protein, 108 aa, Artificial Sequence
  Description of Artificial Sequence: Synthetic polypeptide
DIVLTQTPATLSVSPGEGATLSCRASQSVRSNLAWFQQRPGQVPRLLIYDASTRATGVPARFTGSGSGTYFTLTISSLQSEDFAVYYCQQYNSWPPLTFGGGTKLEIK

SEQ ID NO: 1113 - protein, 23 aa, Artificial Sequence
  Description of Artificial Sequence: Synthetic peptide
DIVLTQTPATLSVSPGEGATLSC

SEQ ID NO: 1114 - protein, 11 aa, Artificial Sequence
  Description of Artificial Sequence: Synthetic peptide
RASQSVRSNLA

SEQ ID NO: 1115 - protein, 15 aa, Artificial Sequence
  Description of Artificial Sequence: Synthetic peptide
WFQQRPGQVPRLLIY

SEQ ID NO: 1116 - protein, 7 aa, Artificial Sequence
  Description of Artificial Sequence: Synthetic peptide
DASTRAT

SEQ ID NO: 1117 - protein, 32 aa, Artificial Sequence
  Description of Artificial Sequence: Synthetic polypeptide
GVPARFTGSGSGTYFTLTISSLQSEDFAVYYC

SEQ ID NO: 1118 - protein, 10 aa, Artificial Sequence
  Description of Artificial Sequence: Synthetic peptide
QQYNSWPPLT

SEQ ID NO: 1119 - protein, 10 aa, Artificial Sequence
  Description of Artificial Sequence: Synthetic peptide
FGGGTKLEIK

SEQ ID NO: 1120 - DNA, 324 bp, Artificial Sequence
  Description of Artificial Sequence: Synthetic polynucleotide
gatattgtgctgacgcagactccagccactctgtctgtgtctccaggggaaggagccaccctctcctgcagggccagtcagagtgttagaagcaacttagcctggttccaacagagacctggccaggttcccaggctcctcatctatgatgcatccaccagggccactggtgtcccagccaggttcactggcagtgggtctgggacatatttcactctcaccatcagcagcctgcagtctgaagattttgcagtttattactgtcagcagtataatagctggcctcctctcactttcggcggagggaccaagctggagatcaaa

SEQ ID NO: 1121-1201 - skipped (81 entries)

SEQ ID NO: 1202 - protein, 126 aa, Artificial Sequence
  Description of Artificial Sequence: Synthetic polypeptide
QVQLVQSGGGVVQPGRSLKLSCVVSGFSFSHYGMNWVRQAPGKGLEWVAVMSYDGSDKYYADSVKGRFTISRDISKNTLYLEMNSLRTEDTAVYYCAKKGSPYCGVDCYKGYFDYWGQGTLVTVSS

SEQ ID NO: 1203 - protein, 26 aa, Artificial Sequence
  Description of Artificial Sequence: Synthetic peptide
QVQLVQSGGGVVQPGRSLKLSCVVSG

SEQ ID NO: 1204 - protein, 9 aa, Artificial Sequence
  Description of Artificial Sequence: Synthetic peptide
FSFSHYGMN

SEQ ID NO: 1205 - protein, 14 aa, Artificial Sequence
  Description of Artificial Sequence: Synthetic peptide
WVRQAPGKGLEWVA

SEQ ID NO: 1206 - protein, 17 aa, Artificial Sequence
  Description of Artificial Sequence: Synthetic peptide
VMSYDGSDKYYADSVKG

SEQ ID NO: 1207 - protein, 30 aa, Artificial Sequence
  Description of Artificial Sequence: Synthetic polypeptide
RFTISRDISKNTLYLEMNSLRTEDTAVYYC

SEQ ID NO: 1208 - protein, 19 aa, Artificial Sequence
  Description of Artificial Sequence: Synthetic peptide
AKKGSPYCGVDCYKGYFDY

SEQ ID NO: 1209 - protein, 11 aa, Artificial Sequence
  Description of Artificial Sequence: Synthetic peptide
WGQGTLVTVSS

SEQ ID NO: 1210 - DNA, 378 bp, Artificial Sequence
  Description of Artificial Sequence: Synthetic polynucleotide
caggtgcagctggtgcagtctgggggaggcgtggtccagcctgggaggtccctgaaactctcctgtgtagtctctggattcagcttcagtcactatggcatgaactgggtccgccaggctccaggcaaggggctggagtgggtggcagttatgtcatatgatggaagtgacaagtactatgcagactccgtgaagggccgattcaccatttccagagacatttccaagaacacgctgtatctagaaatgaacagcctgagaactgaggacaccgctgtatattactgtgcgaaaaaggggtccccatattgtggtgttgactgctataaaggctactttgactactggggccagggaaccctggtcaccgtctcctca

SEQ ID NO: 1211 - skipped

SEQ ID NO: 1212 - protein, 107 aa, Artificial Sequence
  Description of Artificial Sequence: Synthetic polypeptide
EIVLTQSPSSLSASVGDRVTITCQASQDIRKCLNWYQHIPGKAPKLLIHDASSLESGVPSRFSGSGSGTDFSFTINSLHPEDIATYYCQQFEDLPITFGQGTRLEIK

SEQ ID NO: 1213 - protein, 23 aa, Artificial Sequence
  Description of Artificial Sequence: Synthetic peptide
EIVLTQSPSSLSASVGDRVTITC

SEQ ID NO: 1214 - protein, 11 aa, Artificial Sequence
  Description of Artificial Sequence: Synthetic peptide
QASQDIRKCLN

SEQ ID NO: 1215 - protein, 15 aa, Artificial Sequence
  Description of Artificial Sequence: Synthetic peptide
WYQHIPGKAPKLLIH

SEQ ID NO: 1216 - protein, 7 aa, Artificial Sequence
  Description of Artificial Sequence: Synthetic peptide
DASSLES

SEQ ID NO: 1217 - protein, 32 aa, Artificial Sequence
  Description of Artificial Sequence: Synthetic polypeptide
GVPSRFSGSGSGTDFSFTINSLHPEDIATYYC

SEQ ID NO: 1218 - protein, 9 aa, Artificial Sequence
  Description of Artificial Sequence: Synthetic peptide
QQFEDLPIT

SEQ ID NO: 1219 - protein, 10 aa, Artificial Sequence
  Description of Artificial Sequence: Synthetic peptide
FGQGTRLEIK

SEQ ID NO: 1220 - DNA, 321 bp, Artificial Sequence
  Description of Artificial Sequence: Synthetic polynucleotide
gaaattgtgctgacccagtctccatcctctctgtctgcatctgtaggagacagagtcaccatcacttgccaggcgagtcaggacattaggaaatgtttaaattggtatcaacacataccagggaaagcccctaagctcctgatccacgacgcttccagtctggaatctggggtcccatcaaggttcagtggaagtggatctgggacagattttagtttcaccatcaacagcctgcaccctgaagatattgcaacatattactgtcaacagtttgaagatctcccgatcaccttcggccaagggacacgactggagattaaa

SEQ ID NO: 1221-1301 - skipped (81 entries)

SEQ ID NO: 1302 - protein, 129 aa, Artificial Sequence
  Description of Artificial Sequence: Synthetic polypeptide
QVQLVQSGAEVRKPGSSVKLSCKASGGTFSTHAISWVRQAPGQRPEWMGGIMPIFGESKDTQKFQGRVTFTADESTTTAYMELRSLRSDDTAIYYCVRDSDPYTATVTSNHYWYAMDVWGQGTTVTVSS

SEQ ID NO: 1303 - protein, 26 aa, Artificial Sequence
  Description of Artificial Sequence: Synthetic peptide
QVQLVQSGAEVRKPGSSVKLSCKASG

SEQ ID NO: 1304 - protein, 9 aa, Artificial Sequence
  Description of Artificial Sequence: Synthetic peptide
GTFSTHAIS

SEQ ID NO: 1305 - protein, 14 aa, Artificial Sequence
  Description of Artificial Sequence: Synthetic peptide
WVRQAPGQRPEWMG

SEQ ID NO: 1306 - protein, 17 aa, Artificial Sequence
  Description of Artificial Sequence: Synthetic peptide
GIMPIFGESKDTQKFQG

SEQ ID NO: 1307 - protein, 30 aa, Artificial Sequence
  Description of Artificial Sequence: Synthetic polypeptide
RVTFTADESTTTAYMELRSLRSDDTAIYYC

SEQ ID NO: 1308 - protein, 22 aa, Artificial Sequence
  Description of Artificial Sequence: Synthetic peptide
VRDSDPYTATVTSNHYWYAMDV

SEQ ID NO: 1309 - protein, 11 aa, Artificial Sequence
  Description of Artificial Sequence: Synthetic peptide
WGQGTTVTVSS

SEQ ID NO: 1310 - DNA, 387 bp, Artificial Sequence
  Description of Artificial Sequence: Synthetic polynucleotide
caggtgcagctggtgcagtctggggctgaggtgaggaagcctgggtcctcggtgaagctctcctgcaaggcttctggaggcaccttcagcactcatgctatcagttgggtgcggcaggcccctggacaacggcctgagtggatgggagggatcatgcctatttttggtgagtcaaaagacacacagaagtttcaaggcagagtcacctttaccgcggacgaatccacgactacagcctacatggagctgaggagcctaagatctgacgacacggccatatattattgtgtgagagactctgacccctacacggcgactgttacgagtaatcactattggtatgctatggacgtctggggccaggggaccacggtcaccgtctcttca

SEQ ID NO: 1311 - skipped

SEQ ID NO: 1312 - protein, 112 aa, Artificial Sequence
  Description of Artificial Sequence: Synthetic polypeptide
ETTLTQSPLSLPVTLGQPASISCRSSQGLVHSNGNTYVNWFHQRPGQSPRRLIYEVSNRDSGVPDRFSGSGSGTDFTLKISRVEAEDIGVYYCMQGTEWPRTFGQGTKVDIK

SEQ ID NO: 1313 - protein, 23 aa, Artificial Sequence
  Description of Artificial Sequence: Synthetic peptide
ETTLTQSPLSLPVTLGQPASISC

SEQ ID NO: 1314 - protein, 16 aa, Artificial Sequence
  Description of Artificial Sequence: Synthetic peptide
RSSQGLVHSNGNTYVN

SEQ ID NO: 1315 - protein, 15 aa, Artificial Sequence
  Description of Artificial Sequence: Synthetic peptide
WFHQRPGQSPRRLIY

SEQ ID NO: 1316 - protein, 7 aa, Artificial Sequence
  Description of Artificial Sequence: Synthetic peptide
EVSNRDS

SEQ ID NO: 1317 - protein, 32 aa, Artificial Sequence
  Description of Artificial Sequence: Synthetic polypeptide
GVPDRFSGSGSGTDFTLKISRVEAEDIGVYYC

SEQ ID NO: 1318 - protein, 9 aa, Artificial Sequence
  Description of Artificial Sequence: Synthetic peptide
MQGTEWPRT

SEQ ID NO: 1319 - protein, 10 aa, Artificial Sequence
  Description of Artificial Sequence: Synthetic peptide
FGQGTKVDIK

SEQ ID NO: 1320 - DNA, 336 bp, Artificial Sequence
  Description of Artificial Sequence: Synthetic polynucleotide
gaaacgacactcacgcagtctccactctccctgcccgtcacccttggacagccggcctccatctcctgcaggtctagtcaaggcctcgtacacagtaatggaaacacctacgtgaattggtttcaccagaggccaggccaatctccaaggcgcctcatttatgaggtttctaaccgggactctggggtcccagacagattcagcggcagtgggtcaggcactgacttcacactgaagatcagcagggtggaggctgaggatattggagtttattactgcatgcaaggtacagagtggcctcggacttttggccaggggaccaaagtggatatcaaa

SEQ ID NO: 1321-1401 - skipped (81 entries)

SEQ ID NO: 1402 - protein, 124 aa, Artificial Sequence
  Description of Artificial Sequence: Synthetic polypeptide
QVQLVQSGAEVKKPGSSVKVSCKISGGTFKNSAFSWARQVPGQGFQWMGGIIPMFGVPHSVQMFQGRVTLTADESTSAVYMELSGLTSDDTAVYYCAREEYSGTVHNFFGMDVWGQGTTVTVSS

SEQ ID NO: 1403 - protein, 26 aa, Artificial Sequence
  Description of Artificial Sequence: Synthetic peptide
QVQLVQSGAEVKKPGSSVKVSCKISG

SEQ ID NO: 1404 - protein, 9 aa, Artificial Sequence
  Description of Artificial Sequence: Synthetic peptide
GTFKNSAFS

SEQ ID NO: 1405 - protein, 14 aa, Artificial Sequence
  Description of Artificial Sequence: Synthetic peptide
WARQVPGQGFQWMG

SEQ ID NO: 1406 - protein, 17 aa, Artificial Sequence
  Description of Artificial Sequence: Synthetic peptide
GIIPMFGVPHSVQMFQG

SEQ ID NO: 1407 - protein, 30 aa, Artificial Sequence
  Description of Artificial Sequence: Synthetic polypeptide
RVTLTADESTSAVYMELSGLTSDDTAVYYC

SEQ ID NO: 1408 - protein, 17 aa, Artificial Sequence
  Description of Artificial Sequence: Synthetic peptide
AREEYSGTVHNFFGMDV

SEQ ID NO: 1409 - protein, 11 aa, Artificial Sequence
  Description of Artificial Sequence: Synthetic peptide
WGQGTTVTVSS

SEQ ID NO: 1410 - DNA, 372 bp, Artificial Sequence
  Description of Artificial Sequence: Synthetic polynucleotide
caggtccagctggtacagtctggggctgaggtgaagaagcctgggtcctcggtgaaagtctcctgcaagatttccggaggcaccttcaagaattctgcttttagttgggcgcgacaggtccctgggcaaggatttcagtggatgggaggaatcatccctatgtttggtgtgccgcactccgtacagatgtttcaaggcagagtcaccctcaccgcggacgagtccacgagtgcagtctacatggaattgagcggcctgacctctgacgacacggccgtctactactgtgcgagagaggaatattcggggactgttcataacttcttcggtatggacgtctggggccaagggaccacggtcaccgtctcctca

SEQ ID NO: 1411 - skipped

SEQ ID NO: 1412 - protein, 112 aa, Artificial Sequence
  Description of Artificial Sequence: Synthetic polypeptide
DIRMTQSPLSLPVTRGQPASISCRSSHNVVHSDGKTYLNWFHQRPGQAPRRLIYQVSKRDSGVPDRFSGSGSGSDFTLTISRVEAEDVGVYYCMQGTDWPRSFGGGTKVEIK

SEQ ID NO: 1413 - protein, 23 aa, Artificial Sequence
  Description of Artificial Sequence: Synthetic peptide
DIRMTQSPLSLPVTRGQPASISC

SEQ ID NO: 1414 - protein, 16 aa, Artificial Sequence
  Description of Artificial Sequence: Synthetic peptide
RSSHNVVHSDGKTYLN

SEQ ID NO: 1415 - protein, 15 aa, Artificial Sequence
  Description of Artificial Sequence: Synthetic peptide
WFHQRPGQAPRRLIY

SEQ ID NO: 1416 - protein, 7 aa, Artificial Sequence
  Description of Artificial Sequence: Synthetic peptide
QVSKRDS

SEQ ID NO: 1417 - protein, 32 aa, Artificial Sequence
  Description of Artificial Sequence: Synthetic polypeptide
GVPDRFSGSGSGSDFTLTISRVEAEDVGVYYC

SEQ ID NO: 1418 - protein, 9 aa, Artificial Sequence
  Description of Artificial Sequence: Synthetic peptide
MQGTDWPRS

SEQ ID NO: 1419 - protein, 10 aa, Artificial Sequence
  Description of Artificial Sequence: Synthetic peptide
FGGGTKVEIK

SEQ ID NO: 1420 - DNA, 336 bp, Artificial Sequence
  Description of Artificial Sequence: Synthetic polynucleotide
gacatccggatgacccagtctccactctccctgcccgtcacccgtggacagccggcctccatttcctgtaggtctagtcacaatgtcgtccacagtgatggaaaaacctacttgaattggtttcaccagaggccaggccaagctccgaggcgcctaatttatcaggtttctaagcgggactctggggtcccggacagattcagcggcagtgggtcaggctctgatttcacactgacaatcagccgggtggaggctgaggatgttggggtttattactgcatgcaaggtacagactggcctcggtctttcggcggagggaccaaggtggagatcaaa

SEQ ID NO: 1421-1501 - skipped (81 entries)

SEQ ID NO: 1502 - protein, 126 aa, Artificial Sequence
  Description of Artificial Sequence: Synthetic polypeptide
QVQLVQSGAELKKPGSSVRVSCKAAGGTLTNYAISWVRQAPGQGFEWMGGIMPVSHTAGYAQKFQGRVTFTADESATTAYMDLTSLRPEDTAIYYCARDPSIHYTGNHHWYDLDIWGQGTTVTVSS

SEQ ID NO: 1503 - protein, 26 aa, Artificial Sequence
  Description of Artificial Sequence: Synthetic peptide
QVQLVQSGAELKKPGSSVRVSCKAAG

SEQ ID NO: 1504 - protein, 9 aa, Artificial Sequence
  Description of Artificial Sequence: Synthetic peptide
GTLTNYAIS

SEQ ID NO: 1505 - protein, 14 aa, Artificial Sequence
  Description of Artificial Sequence: Synthetic peptide
WVRQAPGQGFEWMG

SEQ ID NO: 1506 - protein, 17 aa, Artificial Sequence
  Description of Artificial Sequence: Synthetic peptide
GIMPVSHTAGYAQKFQG

SEQ ID NO: 1507 - protein, 30 aa, Artificial Sequence
  Description of Artificial Sequence: Synthetic polypeptide
RVTFTADESATTAYMDLTSLRPEDTAIYYC

SEQ ID NO: 1508 - protein, 19 aa, Artificial Sequence
  Description of Artificial Sequence: Synthetic peptide
ARDPSIHYTGNHHWYDLDI

SEQ ID NO: 1509 - protein, 11 aa, Artificial Sequence
  Description of Artificial Sequence: Synthetic peptide
WGQGTTVTVSS

SEQ ID NO: 1510 - DNA, 378 bp, Artificial Sequence
  Description of Artificial Sequence: Synthetic polynucleotide
caggtccagcttgtgcagtctggggctgagttgaagaagcctgggtcgtcggtgagggtctcctgcaaggcggctggaggcaccctcactaattatgccataagttgggtgcgacaggcccctggacaagggtttgagtggatgggagggatcatgcctgtctctcatacggcaggctacgcacagaaatttcaaggccgagtcacctttaccgcggacgaatccgcgaccacagcctacatggacctaacgagcctgagacctgaggacacggccatatattactgtgccagagatccgtctattcattacactgggaatcaccattggtatgatttagatatctggggccaagggaccacggtcaccgtctcctca

SEQ ID NO: 1511 - skipped

SEQ ID NO: 1512 - protein, 112 aa, Artificial Sequence
  Description of Artificial Sequence: Synthetic polypeptide
DIVLTQSPLSLPVTLGQPASISCRSSQRIAHTDGNTYLNWFLQRPGQSPRRLIYKVSNRDSGVPDRFSGSGSGTDFTLKISRVEAEDVGIYYCMQGTEWPRTFGQGTKVEIK

SEQ ID NO: 1513 - protein, 23 aa, Artificial Sequence
  Description of Artificial Sequence: Synthetic peptide
DIVLTQSPLSLPVTLGQPASISC

SEQ ID NO: 1514 - protein, 16 aa, Artificial Sequence
  Description of Artificial Sequence: Synthetic peptide
RSSQRIAHTDGNTYLN

SEQ ID NO: 1515 - protein, 15 aa, Artificial Sequence
  Description of Artificial Sequence: Synthetic peptide
WFLQRPGQSPRRLIY

SEQ ID NO: 1516 - protein, 7 aa, Artificial Sequence
  Description of Artificial Sequence: Synthetic peptide
KVSNRDS

SEQ ID NO: 1517 - protein, 32 aa, Artificial Sequence
  Description of Artificial Sequence: Synthetic polypeptide
GVPDRFSGSGSGTDFTLKISRVEAEDVGIYYC

SEQ ID NO: 1518 - protein, 9 aa, Artificial Sequence
  Description of Artificial Sequence: Synthetic peptide
MQGTEWPRT

SEQ ID NO: 1519 - protein, 10 aa, Artificial Sequence
  Description of Artificial Sequence: Synthetic peptide
FGQGTKVEIK

SEQ ID NO: 1520 - DNA, 336 bp, Artificial Sequence
  Description of Artificial Sequence: Synthetic polynucleotide
gatattgtgctgacccagtctccactctccctgcccgtcacccttggccagccggcctccatctcctgcaggtctagtcaaagaatcgcccacactgatggaaacacctacttgaattggtttctgcagaggccaggccaatctccaaggcgcctaatttataaggtctctaaccgggactccggggtcccagacagattcagcggcagtgggtcaggcactgatttcacactgaaaatcagcagggtggaggctgaggatgttggaatttattactgcatgcaaggtacagagtggcctcggacgttcggccaagggaccaaggtggaaatcaaa

SEQ ID NO: 1521-1601 - skipped (81 entries)

SEQ ID NO: 1602 - protein, 121 aa, Artificial Sequence
  Description of Artificial Sequence: Synthetic polypeptide
EVQLVESGGGVVQPGRSLRLSCAASGFTFSGYPMHWVRQAPGKGLEWVALISFDGDSKYYTDSVKARFAISRDNSKNTLFLQMNSLRVADTALYYCARAKGGSYSNAFDYWGQGTLVTVSS

SEQ ID NO: 1603 - protein, 26 aa, Artificial Sequence
  Description of Artificial Sequence: Synthetic peptide
EVQLVESGGGVVQPGRSLRLSCAASG

SEQ ID NO: 1604 - protein, 9 aa, Artificial Sequence
  Description of Artificial Sequence: Synthetic peptide
FTFSGYPMH

SEQ ID NO: 1605 - protein, 14 aa, Artificial Sequence
  Description of Artificial Sequence: Synthetic peptide
WVRQAPGKGLEWVA

SEQ ID NO: 1606 - protein, 17 aa, Artificial Sequence
  Description of Artificial Sequence: Synthetic peptide
LISFDGDSKYYTDSVKA

SEQ ID NO: 1607 - protein, 30 aa, Artificial Sequence
  Description of Artificial Sequence: Synthetic polypeptide
RFAISRDNSKNTLFLQMNSLRVADTALYYC

SEQ ID NO: 1608 - protein, 14 aa, Artificial Sequence
  Description of Artificial Sequence: Synthetic peptide
ARAKGGSYSNAFDY

SEQ ID NO: 1609 - protein, 11 aa, Artificial Sequence
  Description of Artificial Sequence: Synthetic peptide
WGQGTLVTVSS

SEQ ID NO: 1610 - DNA, 363 bp, Artificial Sequence
  Description of Artificial Sequence: Synthetic polynucleotide
gaggtgcagctggtggagtctgggggaggcgtggtccagcctgggaggtccctgagactctcctgtgcagcctctggtttcaccttcagtggctatcctatgcactgggtccgccaggctccaggcaaggggctggagtgggtggcactaatatcatttgatggagacagtaaatactacacagactccgtgaaggcccgattcgccatctccagagacaattccaagaacacactgtttctgcaaatgaacagcctgagagttgcggacacggctctgtattactgtgcgagagctaagggtgggagctactccaatgcctttgactactggggccagggaaccctggtcaccgtctcctca

SEQ ID NO: 1611 - skipped

SEQ ID NO: 1612 - protein, 114 aa, Artificial Sequence
  Description of Artificial Sequence: Synthetic polypeptide
EIVLTQSPDSLAVSLGERATINCKSSQSVLYSSNNENCLAWYQQKPGQPPKLLIYWASTRESGVPDRFSGSGSGTDFTLTISSLQAEDVAVYYCQQYCSTPPYTFGQGTKVDIK

SEQ ID NO: 1613 - protein, 23 aa, Artificial Sequence
  Description of Artificial Sequence: Synthetic peptide
EIVLTQSPDSLAVSLGERATINC

SEQ ID NO: 1614 - protein, 17 aa, Artificial Sequence
  Description of Artificial Sequence: Synthetic peptide
KSSQSVLYSSNNENCLA

SEQ ID NO: 1615 - protein, 15 aa, Artificial Sequence
  Description of Artificial Sequence: Synthetic peptide
WYQQKPGQPPKLLIY

SEQ ID NO: 1616 - protein, 7 aa, Artificial Sequence
  Description of Artificial Sequence: Synthetic peptide
WASTRES

SEQ ID NO: 1617 - protein, 32 aa, Artificial Sequence
  Description of Artificial Sequence: Synthetic polypeptide
GVPDRFSGSGSGTDFTLTISSLQAEDVAVYYC

SEQ ID NO: 1618 - protein, 10 aa, Artificial Sequence
  Description of Artificial Sequence: Synthetic peptide
QQYCSTPPYT

SEQ ID NO: 1619 - protein, 10 aa, Artificial Sequence
  Description of Artificial Sequence: Synthetic peptide
FGQGTKVDIK

SEQ ID NO: 1620 - DNA, 342 bp, Artificial Sequence
  Description of Artificial Sequence: Synthetic polynucleotide
gaaattgtgttgacacagtctcctgactccctggctgtgtctctgggcgagagggccaccatcaactgcaagtccagccagagtgttttatacagctccaacaatgagaactgcttagcttggtaccagcagaaaccaggacagcctcctaaactgctcatttactgggcatctacccgggaatcaggggtccctgaccgattcagtggcagcgggtctgggacagatttcactctcaccatcagcagcctgcaggctgaagatgtggcagtttattactgtcagcaatattgtagtactcctccgtacacttttggccaggggaccaaagtggatatcaaa

SEQ ID NO: 1621-1701 - skipped (81 entries)

SEQ ID NO: 1702 - protein, 126 aa, Artificial Sequence
  Description of Artificial Sequence: Synthetic polypeptide
QVQLVQSGAELKKPGSSVRVSCKAAGGTLTNYAISWVRQAPGQGFEWMGGIMPVSHTAGYAQKFQGRVTFTADESATTAYMDLTSLRPEDTAIYYCARDPSIHYTGNHHWYDLDIWGQGTMVTVSS

SEQ ID NO: 1703 - protein, 26 aa, Artificial Sequence
  Description of Artificial Sequence: Synthetic peptide
QVQLVQSGAELKKPGSSVRVSCKAAG

SEQ ID NO: 1704 - protein, 9 aa, Artificial Sequence
  Description of Artificial Sequence: Synthetic peptide
GTLTNYAIS

SEQ ID NO: 1705 - protein, 14 aa, Artificial Sequence
  Description of Artificial Sequence: Synthetic peptide
WVRQAPGQGFEWMG

SEQ ID NO: 1706 - protein, 17 aa, Artificial Sequence
  Description of Artificial Sequence: Synthetic peptide
GIMPVSHTAGYAQKFQG

SEQ ID NO: 1707 - protein, 30 aa, Artificial Sequence; identical to SEQ ID NO: 1507
  Description of Artificial Sequence: Synthetic polypeptide

SEQ ID NO: 1708 - protein, 19 aa, Artificial Sequence
  Description of Artificial Sequence: Synthetic peptide
ARDPSIHYTGNHHWYDLDI

SEQ ID NO: 1709 - protein, 11 aa, Artificial Sequence
  Description of Artificial Sequence: Synthetic peptide
WGQGTMVTVSS

SEQ ID NO: 1710 - DNA, 378 bp, Artificial Sequence
  Description of Artificial Sequence: Synthetic polynucleotide
caggtccagcttgtgcagtctggggctgagttgaagaagcctgggtcgtcggtgagggtctcctgcaaggcggctggaggcaccctcactaattatgccataagttgggtgcgacaggcccctggacaagggtttgagtggatgggagggatcatgcctgtctctcatacggcaggctacgcacagaaatttcagggccgagtcacctttaccgcggacgaatccgcgaccacagcctacatggacctaacgagcctgagacctgaggacacggccatatattactgtgccagagatccgtctattcattacactgggaatcaccattggtatgatttagatatctggggccaagggacaatggtcaccgtctcttca

SEQ ID NO: 1711 - skipped

SEQ ID NO: 1712 - protein, 112 aa, Artificial Sequence
  Description of Artificial Sequence: Synthetic polypeptide
DIRLTQSPLSLPVTLGQPASISCRSSQRIVHTDGNTYLNWFLQRPGQSPRRLIYKVSNRDSGVPDRFSGSGSGTDFTLKISRVEAEDVGIYYCMQGTEWPRTFGQGTKVDIK

SEQ ID NO: 1713 - protein, 23 aa, Artificial Sequence
  Description of Artificial Sequence: Synthetic peptide
DIRLTQSPLSLPVTLGQPASISC

SEQ ID NO: 1714 - protein, 16 aa, Artificial Sequence
  Description of Artificial Sequence: Synthetic peptide
RSSQRIVHTDGNTYLN

SEQ ID NO: 1715 - protein, 15 aa, Artificial Sequence
  Description of Artificial Sequence: Synthetic peptide
WFLQRPGQSPRRLIY

SEQ ID NO: 1716 - protein, 7 aa, Artificial Sequence
  Description of Artificial Sequence: Synthetic peptide
KVSNRDS

SEQ ID NO: 1717 - protein, 32 aa, Artificial Sequence; identical to SEQ ID NO: 1517
  Description of Artificial Sequence: Synthetic polypeptide

SEQ ID NO: 1718 - protein, 9 aa, Artificial Sequence
  Description of Artificial Sequence: Synthetic peptide
MQGTEWPRT

SEQ ID NO: 1719 - protein, 10 aa, Artificial Sequence
  Description of Artificial Sequence: Synthetic peptide
FGQGTKVDIK

SEQ ID NO: 1720 - DNA, 336 bp, Artificial Sequence
  Description of Artificial Sequence: Synthetic polynucleotide
gacatccggttgacccagtctccactctccctgcccgtcacccttggccagccggcctccatctcctgcaggtctagtcaaagaatcgtccacactgatggaaacacctacttgaattggtttctgcagaggccaggccaatctccaaggcgcctaatttataaggtctctaaccgggactccggggtcccagacagattcagcggcagtgggtcaggcactgatttcacactgaaaatcagcagggtggaggctgaggatgttggaatttattactgcatgcaaggtacagagtggcctcggacgttcggccaagggaccaaagtggatatcaaa

SEQ ID NO: 1721-1801 - skipped (81 entries)

SEQ ID NO: 1802 - protein, 129 aa, Artificial Sequence
  Description of Artificial Sequence: Synthetic polypeptide
EVQLVESGAEVRTPGSSVKLSCKASGGTFSTHAFSWVRQAPGQRPEWMGGIIPIFGESKDTQKFQGRVTFTADESTTTVYMELRSLKSDDTAIYYCVRDSDPYTATYRNNHYWYAMDVWGQGTTVTVSS

SEQ ID NO: 1803 - protein, 26 aa, Artificial Sequence
  Description of Artificial Sequence: Synthetic peptide
EVQLVESGAEVRTPGSSVKLSCKASG

SEQ ID NO: 1804 - protein, 9 aa, Artificial Sequence
  Description of Artificial Sequence: Synthetic peptide
GTFSTHAFS

SEQ ID NO: 1805 - protein, 14 aa, Artificial Sequence
  Description of Artificial Sequence: Synthetic peptide
WVRQAPGQRPEWMG

SEQ ID NO: 1806 - protein, 17 aa, Artificial Sequence
  Description of Artificial Sequence: Synthetic peptide
GIIPIFGESKDTQKFQG

SEQ ID NO: 1807 - protein, 30 aa, Artificial Sequence
  Description of Artificial Sequence: Synthetic polypeptide
RVTFTADESTTTVYMELRSLKSDDTAIYYC

SEQ ID NO: 1808 - protein, 22 aa, Artificial Sequence
  Description of Artificial Sequence: Synthetic peptide
VRDSDPYTATYRNNHYWYAMDV

SEQ ID NO: 1809 - protein, 11 aa, Artificial Sequence
  Description of Artificial Sequence: Synthetic peptide
WGQGTTVTVSS

SEQ ID NO: 1810 - DNA, 387 bp, Artificial Sequence
  Description of Artificial Sequence: Synthetic polynucleotide
gaggtgcagctggtggagtctggggctgaggtgaggacgcctgggtcctcggtgaagctctcctgtaaggcttctggaggcaccttcagcactcatgctttcagttgggtgcggcaggcccctggacaacggcctgagtggatgggagggatcatccctatttttggtgagtcaaaagacacacagaagtttcaaggcagagtcacctttacggcggacgaatccacgactacagtctacatggaattaaggagcctaaaatctgacgacacggccatatattattgtgtgagagactctgacccctacacggcgacttataggaataatcactattggtatgctatggacgtctggggccaggggaccacggtcaccgtctcctca

SEQ ID NO: 1811 - skipped

SEQ ID NO: 1812 - protein, 112 aa, Artificial Sequence
  Description of Artificial Sequence: Synthetic polypeptide
EIVLTQSPLSLPVTLGQPASISCRSSLRLVHTDGNTYLNWFQQRPGQSPRRLIYKVSNRDSGVPDRFSGSGSGTDFTLKISRVEAEDIGVYYCMQGTEWPRTFGQGTKVDIK

SEQ ID NO: 1813 - protein, 23 aa, Artificial Sequence
  Description of Artificial Sequence: Synthetic peptide
EIVLTQSPLSLPVTLGQPASISC

SEQ ID NO: 1814 - protein, 16 aa, Artificial Sequence
  Description of Artificial Sequence: Synthetic peptide
RSSLRLVHTDGNTYLN

SEQ ID NO: 1815 - protein, 15 aa, Artificial Sequence
  Description of Artificial Sequence: Synthetic peptide
WFQQRPGQSPRRLIY

SEQ ID NO: 1816 - protein, 7 aa, Artificial Sequence
  Description of Artificial Sequence: Synthetic peptide
KVSNRDS

SEQ ID NO: 1817 - protein, 32 aa, Artificial Sequence; identical to SEQ ID NO: 1317
  Description of Artificial Sequence: Synthetic polypeptide

SEQ ID NO: 1818 - protein, 9 aa, Artificial Sequence
  Description of Artificial Sequence: Synthetic peptide
MQGTEWPRT

SEQ ID NO: 1819 - protein, 10 aa, Artificial Sequence
  Description of Artificial Sequence: Synthetic peptide
FGQGTKVDIK

SEQ ID NO: 1820 - DNA, 336 bp, Artificial Sequence
  Description of Artificial Sequence: Synthetic polynucleotide
gaaattgtgttgacacagtctccactctccctgcccgtcacccttggacagccggcctccatctcctgcaggtctagtctacgcctcgtccacactgatggaaacacctacttgaattggtttcaacagaggccaggccaatctccaaggcgcctcatttataaggtttctaaccgggactctggggtcccagacagattcagcggcagtgggtcaggcactgacttcacactgaaaatcagcagggtggaggctgaggatattggagtttattactgcatgcaaggtacagagtggcctcggacttttggccaggggaccaaagtggatatcaaa

SEQ ID NO: 1821-1901 - skipped (81 entries)

SEQ ID NO: 1902 - protein, 126 aa, Artificial Sequence; identical to SEQ ID NO: 1702
  Description of Artificial Sequence: Synthetic polypeptide

SEQ ID NO: 1903 - protein, 26 aa, Artificial Sequence
  Description of Artificial Sequence: Synthetic peptide
QVQLVQSGAELKKPGSSVRVSCKAAG

SEQ ID NO: 1904 - protein, 9 aa, Artificial Sequence
  Description of Artificial Sequence: Synthetic peptide
GTLTNYAIS

SEQ ID NO: 1905 - protein, 14 aa, Artificial Sequence
  Description of Artificial Sequence: Synthetic peptide
WVRQAPGQGFEWMG

SEQ ID NO: 1906 - protein, 17 aa, Artificial Sequence
  Description of Artificial Sequence: Synthetic peptide
GIMPVSHTAGYAQKFQG

SEQ ID NO: 1907 - protein, 30 aa, Artificial Sequence; identical to SEQ ID NO: 1507
  Description of Artificial Sequence: Synthetic polypeptide

SEQ ID NO: 1908 - protein, 19 aa, Artificial Sequence
  Description of Artificial Sequence: Synthetic peptide
ARDPSIHYTGNHHWYDLDI

SEQ ID NO: 1909 - protein, 11 aa, Artificial Sequence
  Description of Artificial Sequence: Synthetic peptide
WGQGTMVTVSS

SEQ ID NO: 1910 - DNA, 378 bp, Artificial Sequence
  Description of Artificial Sequence: Synthetic polynucleotide
caggtccagcttgtacagtctggggctgagttgaagaagcctgggtcgtcggtgagggtctcctgcaaggcggctggaggcaccctcactaattatgccataagttgggtgcgacaggcccctggacaagggtttgagtggatgggagggatcatgcctgtctctcatacggcaggctacgcacagaaatttcagggccgagtcacctttaccgcggacgaatccgcgaccacagcctacatggacctaacgagcctgagacctgaggacacggccatatattactgtgccagagatccgtctattcattacactgggaatcaccattggtatgatttagatatctggggccaagggacaatggtcaccgtctcttca

SEQ ID NO: 1911 - skipped

SEQ ID NO: 1912 - protein, 112 aa, Artificial Sequence
  Description of Artificial Sequence: Synthetic polypeptide
ETGLTQIPFSLPVTFGQPASISCRFSQRLVHTDGNTNLNWFLQRPGQFPRGLIYKVFNRDSGVPDRFRGSGSGIDFTLKISRVEVEDVGIYYGMQGTEWLGTFGQGTKVEIK

SEQ ID NO: 1913 - protein, 23 aa, Artificial Sequence
  Description of Artificial Sequence: Synthetic peptide
ETGLTQIPFSLPVTFGQPASISC

SEQ ID NO: 1914 - protein, 16 aa, Artificial Sequence
  Description of Artificial Sequence: Synthetic peptide
RFSQRLVHTDGNTNLN

SEQ ID NO: 1915 - protein, 15 aa, Artificial Sequence
  Description of Artificial Sequence: Synthetic peptide
WFLQRPGQFPRGLIY

SEQ ID NO: 1916 - protein, 7 aa, Artificial Sequence
  Description of Artificial Sequence: Synthetic peptide
KVFNRDS

SEQ ID NO: 1917 - protein, 32 aa, Artificial Sequence
  Description of Artificial Sequence: Synthetic polypeptide
GVPDRFRGSGSGIDFTLKISRVEVEDVGIYYG

SEQ ID NO: 1918 - protein, 9 aa, Artificial Sequence
  Description of Artificial Sequence: Synthetic peptide
MQGTEWLGT

SEQ ID NO: 1919 - protein, 10 aa, Artificial Sequence
  Description of Artificial Sequence: Synthetic peptide
FGQGTKVEIK

SEQ ID NO: 1920 - DNA, 336 bp, Artificial Sequence
  Description of Artificial Sequence: Synthetic polynucleotide
gaaacgggattaacccagattccattttccttgccggtcacctttggccagccggcttccatttcttgcaggtttagtcaaagattggtccacactgatggaaacaccaacttaaattggtttttgcagaggccaggccaatttccaaggggcttaatttataaggtttttaaccgggattccggggtcccagacagattcaggggcagtgggtcaggcattgatttcacattgaaaatcagcagggtggaggttgaggatgttggaatttattatggcatgcaaggtacagagtggcttggaacgttcggccaagggaccaaggtggagatcaaa

SEQ ID NO: 1921-2001 - skipped (81 entries)

SEQ ID NO: 2002 - protein, 124 aa, Artificial Sequence
  Description of Artificial Sequence: Synthetic polypeptide
QVQLQQWGAGLLKPSETLSLSCAVYGGSFSGFYWSWIRQPPGKGLEWIGEINHSGSANYNPSLMSRVTISMDTSKKQFSLQLRSVTAADTAVYYCARGQESPIVGVTGRWFDPWGQGTLVTVSS

SEQ ID NO: 2003 - protein, 26 aa, Artificial Sequence
  Description of Artificial Sequence: Synthetic peptide
QVQLQQWGAGLLKPSETLSLSCAVYG

SEQ ID NO: 2004 - protein, 9 aa, Artificial Sequence
  Description of Artificial Sequence: Synthetic peptide
GSFSGFYWS

SEQ ID NO: 2005 - protein, 14 aa, Artificial Sequence
  Description of Artificial Sequence: Synthetic peptide
WIRQPPGKGLEWIG

SEQ ID NO: 2006 - protein, 16 aa, Artificial Sequence
  Description of Artificial Sequence: Synthetic peptide
EINHSGSANYNPSLMS

SEQ ID NO: 2007 - protein, 30 aa, Artificial Sequence
  Description of Artificial Sequence: Synthetic polypeptide
RVTISMDTSKKQFSLQLRSVTAADTAVYYC

SEQ ID NO: 2008 - protein, 18 aa, Artificial Sequence
  Description of Artificial Sequence: Synthetic peptide
ARGQESPIVGVTGRWFDP

SEQ ID NO: 2009 - protein, 11 aa, Artificial Sequence
  Description of Artificial Sequence: Synthetic peptide
WGQGTLVTVSS

SEQ ID NO: 2010 - DNA, 372 bp, Artificial Sequence
  Description of Artificial Sequence: Synthetic polynucleotide
caggtgcagctacagcagtggggcgcaggactgttgaagccttcggagaccctgtccctcagttgcgctgtctatggtgggtccttcagtggtttctactggagttggatccgccagcccccagggaaggggctggagtggattggggaaatcaatcatagtggaagcgccaactacaacccgtccctcatgagtcgagtcaccatatcaatggacacgtccaagaagcagttctccctgcagctgaggtctgtgaccgccgcggacacggctgtatattactgtgcgagagggcaagagagcccaatagtgggagtcactggaaggtggttcgacccctggggccagggaaccctggtcaccgtctcctca

SEQ ID NO: 2011 - skipped

SEQ ID NO: 2012 - protein, 115 aa, Artificial Sequence
  Description of Artificial Sequence: Synthetic polypeptide
QPVLTQPASVSGSPGQSVTISCTGTSSDVGSYSDVGNYVSWYQHHPGKAPKLMIYEVRTRPSWVSTRFSGSKSGTTASLTISGLQAEDEADYYCCSYAGASPFVVFGGGTKLTVL

SEQ ID NO: 2013 - protein, 22 aa, Artificial Sequence
  Description of Artificial Sequence: Synthetic peptide
QPVLTQPASVSGSPGQSVTISC

SEQ ID NO: 2014 - protein, 18 aa, Artificial Sequence
  Description of Artificial Sequence: Synthetic peptide
TGTSSDVGSYSDVGNYVS

SEQ ID NO: 2015 - protein, 15 aa, Artificial Sequence
  Description of Artificial Sequence: Synthetic peptide
WYQHHPGKAPKLMIY

SEQ ID NO: 2016 - protein, 7 aa, Artificial Sequence
  Description of Artificial Sequence: Synthetic peptide
EVRTRPS

SEQ ID NO: 2017 - protein, 32 aa, Artificial Sequence
  Description of Artificial Sequence: Synthetic polypeptide
WVSTRFSGSKSGTTASLTISGLQAEDEADYYC

SEQ ID NO: 2018 - protein, 11 aa, Artificial Sequence
  Description of Artificial Sequence: Synthetic peptide
CSYAGASPFVV

SEQ ID NO: 2019 - protein, 10 aa, Artificial Sequence
  Description of Artificial Sequence: Synthetic peptide
FGGGTKLTVL

SEQ ID NO: 2020 - DNA, 345 bp, Artificial Sequence
  Description of Artificial Sequence: Synthetic polynucleotide
cagcctgtgctgactcagcctgcctccgtgtctgggtctcctggacagtcggtcaccatctcctgcactggaaccagcagtgatgttgggagttatagtgatgttgggaattatgtctcctggtaccagcaccacccaggcaaagcccccaaactcatgatttatgaggtcaggacgcggccctcttgggtttctactcgcttctccggctccaagtctggcaccacggcctccctgacaatctctgggctccaggctgaggacgaggctgattactactgctgctcatatgcaggtgctagccctttcgtggtattcggcggagggaccaagctgaccgtcctc

SEQ ID NO: 2021-2101 - skipped (81 entries)

SEQ ID NO: 2102 - protein, 129 aa, Artificial Sequence
  Description of Artificial Sequence: Synthetic polypeptide
QVQLQQWGAGLLKPSETLSLTCAVYGGSFSGFHWSWIRQPPGKGLEWIGEVNHSGSTKYNPSLKSRVTVSVDTSKNQFSLRLSSVTAADTAIYYCARGSLSREYDFLTAPQNGPWFDSWGQGALVTVSS

SEQ ID NO: 2103 - protein, 26 aa, Artificial Sequence
  Description of Artificial Sequence: Synthetic peptide
QVQLQQWGAGLLKPSETLSLTCAVYG

SEQ ID NO: 2104 - protein, 9 aa, Artificial Sequence
  Description of Artificial Sequence: Synthetic peptide
GSFSGFHWS

SEQ ID NO: 2105 - protein, 14 aa, Artificial Sequence
  Description of Artificial Sequence: Synthetic peptide
WIRQPPGKGLEWIG

SEQ ID NO: 2106 - protein, 16 aa, Artificial Sequence
  Description of Artificial Sequence: Synthetic peptide
EVNHSGSTKYNPSLKS

SEQ ID NO: 2107 - protein, 30 aa, Artificial Sequence
  Description of Artificial Sequence: Synthetic polypeptide
RVTVSVDTSKNQFSLRLSSVTAADTAIYYC

SEQ ID NO: 2108 - protein, 23 aa, Artificial Sequence
  Description of Artificial Sequence: Synthetic peptide
ARGSLSREYDFLTAPQNGPWFDS

SEQ ID NO: 2109 - protein, 11 aa, Artificial Sequence
  Description of Artificial Sequence: Synthetic peptide
WGQGALVTVSS

SEQ ID NO: 2110 - DNA, 387 bp, Artificial Sequence
  Description of Artificial Sequence: Synthetic polynucleotide
caggtgcagctacagcagtggggcgcagggctgttgaagccttcggagaccctgtccctcacctgcgctgtctatggtgggtccttcagtggtttccactggagctggatccgccagcccccagggaaggggctggagtggattggggaagtcaatcatagtggcagcaccaaatacaacccgtccctcaagagtcgagtcaccgtttcagtagacacgtccaagaaccagttctccctgaggctgagctctgtgaccgccgcggacacggctatatattactgtgcgagagggtcgctttcgagagagtacgactttttgactgctccccaaaatgggccgtggttcgactcctggggccagggagccctggtcaccgtctcctca

SEQ ID NO: 2111 - skipped

SEQ ID NO: 2112 - protein, 110 aa, Artificial Sequence
  Description of Artificial Sequence: Synthetic polypeptide
QSVLTQPPSVSAAPGQKVTISCSGSSSNLGNNYVSWYQQLPGTAPKLLIYDNHKRPSGIPDRFSGSKSGTSATLGITGLQTGDEADYYCETWDSSLSVVVFGGGTKVTVL

SEQ ID NO: 2113 - protein, 22 aa, Artificial Sequence
  Description of Artificial Sequence: Synthetic peptide
QSVLTQPPSVSAAPGQKVTISC

SEQ ID NO: 2114 - protein, 13 aa, Artificial Sequence
  Description of Artificial Sequence: Synthetic peptide
SGSSSNLGNNYVS

SEQ ID NO: 2115 - protein, 15 aa, Artificial Sequence
  Description of Artificial Sequence: Synthetic peptide
WYQQLPGTAPKLLIY

SEQ ID NO: 2116 - protein, 7 aa, Artificial Sequence
  Description of Artificial Sequence: Synthetic peptide
DNHKRPS

SEQ ID NO: 2117 - protein, 32 aa, Artificial Sequence
  Description of Artificial Sequence: Synthetic polypeptide
GIPDRFSGSKSGTSATLGITGLQTGDEADYYC

SEQ ID NO: 2118 - protein, 11 aa, Artificial Sequence
  Description of Artificial Sequence: Synthetic peptide
ETWDSSLSVVV

SEQ ID NO: 2119 - protein, 10 aa, Artificial Sequence
  Description of Artificial Sequence: Synthetic peptide
FGGGTKVTVL

SEQ ID NO: 2120 - DNA, 330 bp, Artificial Sequence
  Description of Artificial Sequence: Synthetic polynucleotide
cagtctgtgttgacgcagccgccctcagtgtctgcggccccaggacagaaggtcaccatctcctgctctggaagcagctccaaccttgggaataattatgtctcctggtaccagcagctcccaggaacagcccccaagcttctcatttatgacaatcataagcgaccctcagggattcctgaccgattctctggctccaagtctggcacgtcagccaccctgggcatcaccggactccagactggggacgaggccgattattactgcgaaacatgggatagcagcctgagtgttgtggttttcggcggagggaccaaggtgaccgtccta

SEQ ID NO: 2121-2201 - skipped (81 entries)

SEQ ID NO: 2202 - protein, 129 aa, Artificial Sequence; identical to SEQ ID NO: 2102
  Description of Artificial Sequence: Synthetic polypeptide

SEQ ID NO: 2203 - protein, 26 aa, Artificial Sequence
  Description of Artificial Sequence: Synthetic peptide
QVQLQQWGAGLLKPSETLSLTCAVYG

SEQ ID NO: 2204 - protein, 9 aa, Artificial Sequence
  Description of Artificial Sequence: Synthetic peptide
GSFSGFHWS

SEQ ID NO: 2205 - protein, 14 aa, Artificial Sequence
  Description of Artificial Sequence: Synthetic peptide
WIRQPPGKGLEWIG

SEQ ID NO: 2206 - protein, 16 aa, Artificial Sequence
  Description of Artificial Sequence: Synthetic peptide
EVNHSGSTKYNPSLKS

SEQ ID NO: 2207 - protein, 30 aa, Artificial Sequence; identical to SEQ ID NO: 2107
  Description of Artificial Sequence: Synthetic polypeptide

SEQ ID NO: 2208 - protein, 23 aa, Artificial Sequence
  Description of Artificial Sequence: Synthetic peptide
ARGSLSREYDFLTAPQNGPWFDS

SEQ ID NO: 2209 - protein, 11 aa, Artificial Sequence
  Description of Artificial Sequence: Synthetic peptide
WGQGALVTVSS

SEQ ID NO: 2210 - DNA, 387 bp, Artificial Sequence; identical to SEQ ID NO: 2110
  Description of Artificial Sequence: Synthetic polynucleotide

SEQ ID NO: 2211 - skipped

SEQ ID NO: 2212 - protein, 110 aa, Artificial Sequence
  Description of Artificial Sequence: Synthetic polypeptide
QSVVTQPPSVSAAPGQKVTISCSGSSSNLGNNYVSWYQQLPGTAPKLLIYDNHKRPSGIPDRFSGSKSGTSATLGITGLQTGDEADYYCETWDGSLSVVVFGGGTKVTVL

SEQ ID NO: 2213 - protein, 22 aa, Artificial Sequence
  Description of Artificial Sequence: Synthetic peptide
QSVVTQPPSVSAAPGQKVTISC

SEQ ID NO: 2214 - protein, 13 aa, Artificial Sequence
  Description of Artificial Sequence: Synthetic peptide
SGSSSNLGNNYVS

SEQ ID NO: 2215 - protein, 15 aa, Artificial Sequence
  Description of Artificial Sequence: Synthetic peptide
WYQQLPGTAPKLLIY

SEQ ID NO: 2216 - protein, 7 aa, Artificial Sequence
  Description of Artificial Sequence: Synthetic peptide
DNHKRPS

SEQ ID NO: 2217 - protein, 32 aa, Artificial Sequence; identical to SEQ ID NO: 2117
  Description of Artificial Sequence: Synthetic polypeptide

SEQ ID NO: 2218 - protein, 11 aa, Artificial Sequence
  Description of Artificial Sequence: Synthetic peptide
ETWDGSLSVVV

SEQ ID NO: 2219 - protein, 10 aa, Artificial Sequence
  Description of Artificial Sequence: Synthetic peptide
FGGGTKVTVL

SEQ ID NO: 2220 - DNA, 330 bp, Artificial Sequence
  Description of Artificial Sequence: Synthetic polynucleotide
cagtctgtcgtgacgcagccgccctcagtgtctgcggccccaggacagaaggtcaccatctcctgctctggaagcagctccaaccttgggaataattatgtctcctggtaccagcagctcccaggaacagcccccaagcttctcatttatgacaatcataagcgaccctcagggattcctgaccgattctctggctccaagtctggcacgtcagccaccctgggcatcaccggactccagactggggacgaggccgattattactgcgaaacatgggatggcagcctgagtgttgtggttttcggcggagggaccaaggtgaccgtccta

SEQ ID NO: 2221-2301 - skipped (81 entries)

SEQ ID NO: 2302 - protein, 128 aa, Artificial Sequence
  Description of Artificial Sequence: Synthetic polypeptide
EVQLVESGPGLVKPSETLSLTCTVSGASVTAGSSYWGWIRQPPGKGLEWIGYMFSSGNTKYNPSLKSRVTISADTSKNQFSLRLSSVTAADTAVYFCARVGWVRYFDWSKPYYYFDLWGRGTLVTVSS

SEQ ID NO: 2303 - protein, 26 aa, Artificial Sequence
  Description of Artificial Sequence: Synthetic peptide
EVQLVESGPGLVKPSETLSLTCTVSG

SEQ ID NO: 2304 - protein, 11 aa, Artificial Sequence
  Description of Artificial Sequence: Synthetic peptide
ASVTAGSSYWG

SEQ ID NO: 2305 - protein, 14 aa, Artificial Sequence
  Description of Artificial Sequence: Synthetic peptide
WIRQPPGKGLEWIG

SEQ ID NO: 2306 - protein, 16 aa, Artificial Sequence
  Description of Artificial Sequence: Synthetic peptide
YMFSSGNTKYNPSLKS

SEQ ID NO: 2307 - protein, 30 aa, Artificial Sequence
  Description of Artificial Sequence: Synthetic polypeptide
RVTISADTSKNQFSLRLSSVTAADTAVYFC

SEQ ID NO: 2308 - protein, 20 aa, Artificial Sequence
  Description of Artificial Sequence: Synthetic peptide
ARVGWVRYFDWSKPYYYFDL

SEQ ID NO: 2309 - protein, 11 aa, Artificial Sequence
  Description of Artificial Sequence: Synthetic peptide
WGRGTLVTVSS

SEQ ID NO: 2310 - DNA, 384 bp, Artificial Sequence
  Description of Artificial Sequence: Synthetic polynucleotide
gaggtgcagctggtggagtcgggcccaggactggtgaagccttcggagaccctgtccctcacctgcactgtctctggtgcctccgtcactgctggtagttcctactggggctggatccggcagccccccgggaagggactggagtggattgggtacatgttctcaagtgggaacaccaagtacaatccctccctcaagagtcgagtcaccatatcagcagacacgtccaaaaaccagttctccctgagattgagctctgtgaccgctgcggacacggccgtgtatttctgtgcgagagtcggctgggtacgatattttgactggtcaaaaccctactattacttcgatctctggggccgtggcaccctggtcaccgtctcttca

SEQ ID NO: 2311 - skipped

SEQ ID NO: 2312 - protein, 110 aa, Artificial Sequence
  Description of Artificial Sequence: Synthetic polypeptide
QSVLTQPPSVSGAPGQRVTISCTGSSSNIGAGYYVHWYQQLPGTAPKLLIYDNNNRPSGVPDRFSGSRSGTSASLAITGLQAEDEGDYFCQSYDSSLSASFGGGTKVTVL

SEQ ID NO: 2313 - protein, 22 aa, Artificial Sequence
  Description of Artificial Sequence: Synthetic peptide
QSVLTQPPSVSGAPGQRVTISC

SEQ ID NO: 2314 - protein, 14 aa, Artificial Sequence
  Description of Artificial Sequence: Synthetic peptide
TGSSSNIGAGYYVH

SEQ ID NO: 2315 - protein, 15 aa, Artificial Sequence
  Description of Artificial Sequence: Synthetic peptide
WYQQLPGTAPKLLIY

SEQ ID NO: 2316 - protein, 7 aa, Artificial Sequence
  Description of Artificial Sequence: Synthetic peptide
DNNNRPS

SEQ ID NO: 2317 - protein, 32 aa, Artificial Sequence
  Description of Artificial Sequence: Synthetic polypeptide
GVPDRFSGSRSGTSASLAITGLQAEDEGDYFC

SEQ ID NO: 2318 - protein, 10 aa, Artificial Sequence
  Description of Artificial Sequence: Synthetic peptide
QSYDSSLSAS

SEQ ID NO: 2319 - protein, 10 aa, Artificial Sequence
  Description of Artificial Sequence: Synthetic peptide
FGGGTKVTVL

SEQ ID NO: 2320 - DNA, 330 bp, Artificial Sequence
  Description of Artificial Sequence: Synthetic polynucleotide
cagtctgtgctgacgcagccgccctcagtgtctggggccccagggcagagggtcaccatctcctgcactgggagcagctccaacatcggggcaggttattatgtccactggtaccagcagcttccaggaacagcccccaaactcctcatctatgataacaacaatcggccctcaggggtccctgaccgattctctggctccaggtctggcacctcagcctccctggccatcactgggctccaggctgaggatgagggtgattatttctgccagtcctatgacagcagcctgagtgcttcattcggcggagggaccaaggtcaccgtccta

SEQ ID NO: 2321-2401 - skipped (81 entries)

SEQ ID NO: 2402 - protein, 128 aa, Artificial Sequence
  Description of Artificial Sequence: Synthetic polypeptide
EVQLVESGGGLVQPGGSLRLSCAASGFTFSTSAMSWVRQAPGKGLEWVSRIGGGGGRTKYADSVKGRFTISRDNSKNTLYLQMNSLRADDTAVYYCAKCDLVRYFDWLGEENNWFDPWGQGTLVTVSS

SEQ ID NO: 2403 - protein, 26 aa, Artificial Sequence
  Description of Artificial Sequence: Synthetic peptide
EVQLVESGGGLVQPGGSLRLSCAASG

SEQ ID NO: 2404 - protein, 9 aa, Artificial Sequence
  Description of Artificial Sequence: Synthetic peptide
FTFSTSAMS

SEQ ID NO: 2405 - protein, 14 aa, Artificial Sequence
  Description of Artificial Sequence: Synthetic peptide
WVRQAPGKGLEWVS

SEQ ID NO: 2406 - protein, 17 aa, Artificial Sequence
  Description of Artificial Sequence: Synthetic peptide
RIGGGGGRTKYADSVKG

SEQ ID NO: 2407 - protein, 30 aa, Artificial Sequence
  Description of Artificial Sequence: Synthetic polypeptide
RFTISRDNSKNTLYLQMNSLRADDTAVYYC

SEQ ID NO: 2408 - protein, 21 aa, Artificial Sequence
  Description of Artificial Sequence: Synthetic peptide
AKCDLVRYFDWLGEENNWFDP

SEQ ID NO: 2409 - protein, 11 aa, Artificial Sequence
  Description of Artificial Sequence: Synthetic peptide
WGQGTLVTVSS

SEQ ID NO: 2410 - DNA, 384 bp, Artificial Sequence
  Description of Artificial Sequence: Synthetic polynucleotide
gaggtgcagctggtggagtctgggggaggcttggtacagcctggggggtccctgagactctcctgtgcagcctctggattcaccttcagcacttctgccatgagttgggtccgccaggctccagggaaggggctggagtgggtgtcaaggattggtggtggtggtggtaggacaaaatacgcagactccgtgaagggccggttcaccatttccagagacaattccaagaacacactgtatctgcaaatgaacagcctgagagccgacgacacggccgtatattattgtgcgaaatgcgacttagtacgatattttgactggttaggcgaagaaaacaactggttcgacccctggggccagggaaccctggtcaccgtctcctca

SEQ ID NO: 2411 - skipped

SEQ ID NO: 2412 - protein, 111 aa, Artificial Sequence
  Description of Artificial Sequence: Synthetic polypeptide
QSVLTQPPSVSGAPGQRVTISCTGSNSNIGAGYDVHWYQQLPETAPKLLIYANGNRPSGVPDRFSGSKSGTSASLAITGLQAEDEADYYCQSYDSSLSGVLFGGGTKLTVL

SEQ ID NO: 2413 - protein, 22 aa, Artificial Sequence
  Description of Artificial Sequence: Synthetic peptide
QSVLTQPPSVSGAPGQRVTISC

SEQ ID NO: 2414 - protein, 14 aa, Artificial Sequence
  Description of Artificial Sequence: Synthetic peptide
TGSNSNIGAGYDVH

SEQ ID NO: 2415 - protein, 15 aa, Artificial Sequence
  Description of Artificial Sequence: Synthetic peptide
WYQQLPETAPKLLIY

SEQ ID NO: 2416 - protein, 7 aa, Artificial Sequence
  Description of Artificial Sequence: Synthetic peptide
ANGNRPS

SEQ ID NO: 2417 - protein, 32 aa, Artificial Sequence; identical to SEQ ID NO: 117
  Description of Artificial Sequence: Synthetic polypeptide

SEQ ID NO: 2418 - protein, 11 aa, Artificial Sequence
  Description of Artificial Sequence: Synthetic peptide
QSYDSSLSGVL

SEQ ID NO: 2419 - protein, 10 aa, Artificial Sequence
  Description of Artificial Sequence: Synthetic peptide
FGGGTKLTVL

SEQ ID NO: 2420 - DNA, 333 bp, Artificial Sequence
  Description of Artificial Sequence: Synthetic polynucleotide
cagtctgtcttgacgcagccgccctcagtgtctggggccccagggcagagggtcaccatctcctgcactgggagcaactccaacatcggggcaggttatgatgtccactggtaccagcagcttccagaaacagcccccaagctcctcatctatgctaacggcaatcggccctcaggggtccctgaccgattctctggctccaagtctggcacctcagcctccctggccatcactgggctccaggctgaggatgaggctgattattactgccagtcctatgacagcagcctgagtggcgtgctattcggcggagggaccaaactgaccgtccta

SEQ ID NO: 2421-2501 - skipped (81 entries)

SEQ ID NO: 2502 - protein, 129 aa, Artificial Sequence
  Description of Artificial Sequence: Synthetic polypeptide
QVQLVQSGAEVRKPGSSVKLSCKASGGTFSTHAISWVRQAPGQRPEWMGGIMPIFGESKDTQKFQGRVTFTADESTTTAYMELRSLKSDDTAIYYCVRDSDPYTATVRNNHYWYALDVWGPGTMVTVSS

SEQ ID NO: 2503 - protein, 26 aa, Artificial Sequence
  Description of Artificial Sequence: Synthetic peptide
QVQLVQSGAEVRKPGSSVKLSCKASG

SEQ ID NO: 2504 - protein, 9 aa, Artificial Sequence
  Description of Artificial Sequence: Synthetic peptide
GTFSTHAIS

SEQ ID NO: 2505 - protein, 14 aa, Artificial Sequence
  Description of Artificial Sequence: Synthetic peptide
WVRQAPGQRPEWMG

SEQ ID NO: 2506 - protein, 17 aa, Artificial Sequence
  Description of Artificial Sequence: Synthetic peptide
GIMPIFGESKDTQKFQG

SEQ ID NO: 2507 - protein, 30 aa, Artificial Sequence
  Description of Artificial Sequence: Synthetic polypeptide
RVTFTADESTTTAYMELRSLKSDDTAIYYC

SEQ ID NO: 2508 - protein, 22 aa, Artificial Sequence
  Description of Artificial Sequence: Synthetic peptide
VRDSDPYTATVRNNHYWYALDV

SEQ ID NO: 2509 - protein, 11 aa, Artificial Sequence
  Description of Artificial Sequence: Synthetic peptide
WGPGTMVTVSS

SEQ ID NO: 2510 - DNA, 387 bp, Artificial Sequence
  Description of Artificial Sequence: Synthetic polynucleotide
caggtccagcttgtacagtctggggctgaggtgaggaagcctgggtcctcggtgaagctctcctgcaaggcttctggaggcaccttcagcactcatgctatcagttgggtgcggcaggcccctggacaacggcctgagtggatgggagggatcatgcctatttttggtgagtcaaaagacacacagaagtttcaaggcagagtcacctttaccgcggacgaatccacgactacagcctacatggagttgaggagcctaaaatctgacgacacggccatatattattgtgtgagagactctgacccctacacggcgactgttaggaataatcactattggtatgctttggacgtctggggcccggggaccatggtcaccgtctcttca

SEQ ID NO: 2511 - skipped

SEQ ID NO: 2512 - protein, 112 aa, Artificial Sequence
  Description of Artificial Sequence: Synthetic polypeptide
DIQLTQSPLSLPVTLGQPASISCRSSQHLVHSDGNTYLNWFQQRPGQSPRRLIYKVSNRDSGVPDRFSGSGSGIDFTLKISRVEAEDIGVYYCMQGTEWPRTFGQGTKVEIK

SEQ ID NO: 2513 - protein, 23 aa, Artificial Sequence
  Description of Artificial Sequence: Synthetic peptide
DIQLTQSPLSLPVTLGQPASISC

SEQ ID NO: 2514 - protein, 16 aa, Artificial Sequence
  Description of Artificial Sequence: Synthetic peptide
RSSQHLVHSDGNTYLN

SEQ ID NO: 2515 - protein, 15 aa, Artificial Sequence
  Description of Artificial Sequence: Synthetic peptide
WFQQRPGQSPRRLIY

SEQ ID NO: 2516 - protein, 7 aa, Artificial Sequence
  Description of Artificial Sequence: Synthetic peptide
KVSNRDS

SEQ ID NO: 2517 - protein, 32 aa, Artificial Sequence
  Description of Artificial Sequence: Synthetic polypeptide
GVPDRFSGSGSGIDFTLKISRVEAEDIGVYYC

SEQ ID NO: 2518 - protein, 9 aa, Artificial Sequence
  Description of Artificial Sequence: Synthetic peptide
MQGTEWPRT

SEQ ID NO: 2519 - protein, 10 aa, Artificial Sequence
  Description of Artificial Sequence: Synthetic peptide
FGQGTKVEIK

SEQ ID NO: 2520 - DNA, 336 bp, Artificial Sequence
  Description of Artificial Sequence: Synthetic polynucleotide
gacatccagttgacccagtctccactctccctgcccgtcacccttggacagccggcctccatctcctgcaggtctagtcaacacctcgtacacagcgatggaaacacctacttgaattggtttcagcagaggccaggccaatctccaaggcgcctcatttataaggtttctaaccgggactctggggtcccagacagattcagcggcagtgggtcaggcattgacttcacactgaaaatcagcagggtggaggctgaggatattggagtttattactgcatgcaaggtacagagtggcctcggacttttggccaggggaccaaggtggaaatcaaa

SEQ ID NO: 2521-2601 - skipped (81 entries)

SEQ ID NO: 2602 - protein, 128 aa, Artificial Sequence
  Description of Artificial Sequence: Synthetic polypeptide
QVQLQQSGPGLVKPSETLSLTCTVSGASVTAGSSYWGWIRQPPGKGLEWIGYMFSSGNTKYNPSLKSRVTISADTSKNQFSLRLSSVTAADTAVYFCARVGWVRYFDWSKPYYYFDLWGRGTLVTVSS

SEQ ID NO: 2603 - protein, 26 aa, Artificial Sequence
  Description of Artificial Sequence: Synthetic peptide
QVQLQQSGPGLVKPSETLSLTCTVSG

SEQ ID NO: 2604 - protein, 11 aa, Artificial Sequence
  Description of Artificial Sequence: Synthetic peptide
ASVTAGSSYWG

SEQ ID NO: 2605 - protein, 14 aa, Artificial Sequence
  Description of Artificial Sequence: Synthetic peptide
WIRQPPGKGLEWIG

SEQ ID NO: 2606 - protein, 16 aa, Artificial Sequence
  Description of Artificial Sequence: Synthetic peptide
YMFSSGNTKYNPSLKS

SEQ ID NO: 2607 - protein, 30 aa, Artificial Sequence; identical to SEQ ID NO: 2307
  Description of Artificial Sequence: Synthetic polypeptide

SEQ ID NO: 2608 - protein, 20 aa, Artificial Sequence
  Description of Artificial Sequence: Synthetic peptide
ARVGWVRYFDWSKPYYYFDL

SEQ ID NO: 2609 - protein, 11 aa, Artificial Sequence
  Description of Artificial Sequence: Synthetic peptide
WGRGTLVTVSS

SEQ ID NO: 2610 - DNA, 384 bp, Artificial Sequence
  Description of Artificial Sequence: Synthetic polynucleotide
caggtgcagctacagcagtcgggcccaggactggtgaagccttcggagaccctgtccctcacctgcactgtctctggtgcctccgtcactgctggtagttcctactggggctggatccggcagccccccgggaagggactggagtggattgggtacatgttctcaagtgggaacaccaagtacaatccctccctcaagagtcgagtcaccatatcagcagacacgtccaaaaaccagttctccctgagattgagctctgtgaccgctgcggacacggccgtgtatttctgtgcgagagtcggctgggtacgatattttgactggtcaaaaccctactattacttcgatctctggggccgtggcaccctggtcaccgtctcctca

SEQ ID NO: 2611 - skipped

SEQ ID NO: 2612 - protein, 110 aa, Artificial Sequence
  Description of Artificial Sequence: Synthetic polypeptide
QSVLTQPPSVSGAPGQRVTISCTGSSSNVGAGYYVHWYQQLPGTAPKLLIYDNNNRPSGVPDRFSGSRSGTSASLAITGLQAEDEGDYFCQSYDSSLSASFGGGTKLTVL

SEQ ID NO: 2613 - protein, 22 aa, Artificial Sequence
  Description of Artificial Sequence: Synthetic peptide
QSVLTQPPSVSGAPGQRVTISC

SEQ ID NO: 2614 - protein, 14 aa, Artificial Sequence
  Description of Artificial Sequence: Synthetic peptide
TGSSSNVGAGYYVH

SEQ ID NO: 2615 - protein, 15 aa, Artificial Sequence
  Description of Artificial Sequence: Synthetic peptide
WYQQLPGTAPKLLIY

SEQ ID NO: 2616 - protein, 7 aa, Artificial Sequence
  Description of Artificial Sequence: Synthetic peptide
DNNNRPS

SEQ ID NO: 2617 - protein, 32 aa, Artificial Sequence; identical to SEQ ID NO: 2317
  Description of Artificial Sequence: Synthetic polypeptide

SEQ ID NO: 2618 - protein, 10 aa, Artificial Sequence
  Description of Artificial Sequence: Synthetic peptide
QSYDSSLSAS

SEQ ID NO: 2619 - protein, 10 aa, Artificial Sequence
  Description of Artificial Sequence: Synthetic peptide
FGGGTKLTVL

SEQ ID NO: 2620 - DNA, 330 bp, Artificial Sequence
  Description of Artificial Sequence: Synthetic polynucleotide
cagtctgtgttgacgcagccgccctcagtgtctggggccccagggcagagggtcaccatctcctgcactgggagcagctccaacgtcggggcaggttattatgtccactggtaccagcagcttccaggaacagcccccaaactcctcatctatgataacaacaatcggccctcaggggtccctgaccgattctctggctccaggtctggcacctcagcctccctggccatcactgggctccaggctgaggatgagggtgattatttctgccagtcctatgacagcagcctgagtgcttcattcggcggagggaccaagctgaccgtccta

SEQ ID NO: 2621-2701 - skipped (81 entries)

SEQ ID NO: 2702 - protein, 123 aa, Artificial Sequence
  Description of Artificial Sequence: Synthetic polypeptide
EVQLVESGGGLSQPGGSLRLSCAASGFTVRTYCMNWVRQAPGKGLEWVSLVCGDNIDYYPDSVKGRFSISRDDSKNTLLLHMDSLRVEDTAVYYCARATPPGGGTGWPYFDFWGQGTLVTVSS

SEQ ID NO: 2703 - protein, 26 aa, Artificial Sequence
  Description of Artificial Sequence: Synthetic peptide
EVQLVESGGGLSQPGGSLRLSCAASG

SEQ ID NO: 2704 - protein, 9 aa, Artificial Sequence
  Description of Artificial Sequence: Synthetic peptide
FTVRTYCMN

SEQ ID NO: 2705 - protein, 14 aa, Artificial Sequence
  Description of Artificial Sequence: Synthetic peptide
WVRQAPGKGLEWVS

SEQ ID NO: 2706 - protein, 16 aa, Artificial Sequence
  Description of Artificial Sequence: Synthetic peptide
LVCGDNIDYYPDSVKG

SEQ ID NO: 2707 - protein, 30 aa, Artificial Sequence
  Description of Artificial Sequence: Synthetic polypeptide
RFSISRDDSKNTLLLHMDSLRVEDTAVYYC

SEQ ID NO: 2708 - protein, 17 aa, Artificial Sequence
  Description of Artificial Sequence: Synthetic peptide
ARATPPGGGTGWPYFDF

SEQ ID NO: 2709 - protein, 11 aa, Artificial Sequence
  Description of Artificial Sequence: Synthetic peptide
WGQGTLVTVSS

SEQ ID NO: 2710 - DNA, 369 bp, Artificial Sequence
  Description of Artificial Sequence: Synthetic polynucleotide
gaggtgcagctggtggagtccggaggaggcttgagccagcctggggggtccctgagactctcctgtgcagcctctgggttcaccgtcagaacctactgcatgaactgggtccgccaggctccagggaaggggctggagtgggtctcacttgtttgtggcgataatatcgattactacccagactccgttaagggccgattctccatctccagagacgattctaagaacacactgcttcttcatatggacagcctcagagtcgaagacacggccgtatattactgtgcgagagcgacaccccccgggggtggcactggctggccctactttgatttctggggccagggaaccctggtcaccgtctcttca

SEQ ID NO: 2711 - skipped

SEQ ID NO: 2712 - protein, 108 aa, Artificial Sequence
  Description of Artificial Sequence: Synthetic polypeptide
DIQVTQSPATVSVSPGEGASLSCRASQSVRSNLAWFQQKPGQAPRLLISDASTRASGVPARFTGSGFGTEFTLTISSLQSEDFAIYYCQQYNTWPPLTFGGGTKVEIK

SEQ ID NO: 2713 - protein, 23 aa, Artificial Sequence
  Description of Artificial Sequence: Synthetic peptide
DIQVTQSPATVSVSPGEGASLSC

SEQ ID NO: 2714 - protein, 11 aa, Artificial Sequence
  Description of Artificial Sequence: Synthetic peptide
RASQSVRSNLA

SEQ ID NO: 2715 - protein, 15 aa, Artificial Sequence
  Description of Artificial Sequence: Synthetic peptide
WFQQKPGQAPRLLIS

SEQ ID NO: 2716 - protein, 7 aa, Artificial Sequence
  Description of Artificial Sequence: Synthetic peptide
DASTRAS

SEQ ID NO: 2717 - protein, 32 aa, Artificial Sequence
  Description of Artificial Sequence: Synthetic polypeptide
GVPARFTGSGFGTEFTLTISSLQSEDFAIYYC

SEQ ID NO: 2718 - protein, 10 aa, Artificial Sequence
  Description of Artificial Sequence: Synthetic peptide
QQYNTWPPLT

SEQ ID NO: 2719 - protein, 10 aa, Artificial Sequence
  Description of Artificial Sequence: Synthetic peptide
FGGGTKVEIK

SEQ ID NO: 2720 - DNA, 324 bp, Artificial Sequence
  Description of Artificial Sequence: Synthetic polynucleotide
gacatccaggtgacccagtctccagccactgtgtctgtgtctccaggagaaggagcctccctctcctgcagggccagtcagagtgttcgcagcaacttagcctggttccagcagaaacctggccaggctcccaggctcctcatctctgatgcatccaccagggccagtggtgtcccagccaggttcactggcagtggttttgggacagagttcactctcaccatcagcagcctgcagtctgaagattttgcaatttattactgtcaacagtataatacttggcctcctctcactttcggcggagggaccaaggtggaaatcaaa

SEQ ID NO: 2721-2801 - skipped (81 entries)

SEQ ID NO: 2802 - protein, 123 aa, Artificial Sequence
  Description of Artificial Sequence: Synthetic polypeptide
QVQLVQSGAEMRKPGSSVKVSCKASGGTFSRYCFSWVRQAPGQRLEWMGGIMSILGAHYAQKFQGRVTFTADESTNTAYMELISLTSEDTAVYYCAREEPSGTYHNYYGLDVWGQGTTVTVSS

SEQ ID NO: 2803 - protein, 26 aa, Artificial Sequence
  Description of Artificial Sequence: Synthetic peptide
QVQLVQSGAEMRKPGSSVKVSCKASG

SEQ ID NO: 2804 - protein, 9 aa, Artificial Sequence
  Description of Artificial Sequence: Synthetic peptide
GTFSRYCFS

SEQ ID NO: 2805 - protein, 14 aa, Artificial Sequence
  Description of Artificial Sequence: Synthetic peptide
WVRQAPGQRLEWMG

SEQ ID NO: 2806 - protein, 16 aa, Artificial Sequence
  Description of Artificial Sequence: Synthetic peptide
GIMSILGAHYAQKFQG

SEQ ID NO: 2807 - protein, 30 aa, Artificial Sequence
  Description of Artificial Sequence: Synthetic polypeptide
RVTFTADESTNTAYMELISLTSEDTAVYYC

SEQ ID NO: 2808 - protein, 17 aa, Artificial Sequence
  Description of Artificial Sequence: Synthetic peptide
AREEPSGTYHNYYGLDV

SEQ ID NO: 2809 - protein, 11 aa, Artificial Sequence
  Description of Artificial Sequence: Synthetic peptide
WGQGTTVTVSS

SEQ ID NO: 2810 - DNA, 369 bp, Artificial Sequence
  Description of Artificial Sequence: Synthetic polynucleotide
caggtccagcttgtgcagtctggggctgaaatgaggaagcctgggtcctcggtgaaggtctcctgcaaggcttctggaggcaccttcagcaggtattgtttcagctgggtgcgacaggcccctggacaacggctggagtggatgggaggcatcatgtctatccttggtgcacactacgcacagaagttccagggcagagtcacctttaccgcggacgagtccacgaacacggcctacatggagctgatcagcctcacatctgaggacacggccgtgtattattgtgcgagagaggagccttcggggacttatcacaactactacggactggacgtctggggccaggggaccacggtcaccgtctcctca

SEQ ID NO: 2811 - skipped

SEQ ID NO: 2812 - protein, 112 aa, Artificial Sequence
  Description of Artificial Sequence: Synthetic polypeptide
DIRLTQSPLSLPVTLGQPASISCRSSQSLVHSNGNTYLNWFQQRPGQSPRRLIYEVSNRDSGVPDRFTGSGSGTDFTLKISRVEAEDVGVYYCMQGTHWPRSFGGGTKVEIK

SEQ ID NO: 2813 - protein, 23 aa, Artificial Sequence
  Description of Artificial Sequence: Synthetic peptide
DIRLTQSPLSLPVTLGQPASISC

SEQ ID NO: 2814 - protein, 16 aa, Artificial Sequence
  Description of Artificial Sequence: Synthetic peptide
RSSQSLVHSNGNTYLN

SEQ ID NO: 2815 - protein, 15 aa, Artificial Sequence
  Description of Artificial Sequence: Synthetic peptide
WFQQRPGQSPRRLIY

SEQ ID NO: 2816 - protein, 7 aa, Artificial Sequence
  Description of Artificial Sequence: Synthetic peptide
EVSNRDS

SEQ ID NO: 2817 - protein, 32 aa, Artificial Sequence
  Description of Artificial Sequence: Synthetic polypeptide
GVPDRFTGSGSGTDFTLKISRVEAEDVGVYYC

SEQ ID NO: 2818 - protein, 9 aa, Artificial Sequence
  Description of Artificial Sequence: Synthetic peptide
MQGTHWPRS

SEQ ID NO: 2819 - protein, 10 aa, Artificial Sequence
  Description of Artificial Sequence: Synthetic peptide
FGGGTKVEIK

SEQ ID NO: 2820 - DNA, 336 bp, Artificial Sequence
  Description of Artificial Sequence: Synthetic polynucleotide
gacatccggttgacccagtctccactctccctgcccgtcacccttggacagccggcctccatctcctgcaggtctagtcaaagcctcgtacacagtaatggaaacacctacttgaattggtttcagcagaggccaggccaatctccaaggcgcctgatttatgaggtttctaatcgggactctggggtcccagacagattcaccggcagtgggtcaggcactgatttcacactgaaaatcagcagggtggaggctgaggatgttggggtttattactgcatgcaaggtacacactggcctcggtctttcggcggagggaccaaggtggaaatcaaa

SEQ ID NO: 2821-2901 - skipped (81 entries)

SEQ ID NO: 2902 - protein, 130 aa, Artificial Sequence
  Description of Artificial Sequence: Synthetic polypeptide
QVQLQESGPGLVKPSGTLSLTCAVSGGSISSSDWCSWVRQPPGKGPEWIAEISHSGSTNYNPSLKSRVTMSVDRSKNQFSLNLNSVTAADTAVYYCAARIRGATHYDFWSGFWAGPFDIWGQGTTVTVSS

SEQ ID NO: 2903 - protein, 26 aa, Artificial Sequence
  Description of Artificial Sequence: Synthetic peptide
QVQLQESGPGLVKPSGTLSLTCAVSG

SEQ ID NO: 2904 - protein, 10 aa, Artificial Sequence
  Description of Artificial Sequence: Synthetic peptide
GSISSSDWCS

SEQ ID NO: 2905 - protein, 14 aa, Artificial Sequence
  Description of Artificial Sequence: Synthetic peptide
WVRQPPGKGPEWIA

SEQ ID NO: 2906 - protein, 16 aa, Artificial Sequence
  Description of Artificial Sequence: Synthetic peptide
EISHSGSTNYNPSLKS

SEQ ID NO: 2907 - protein, 30 aa, Artificial Sequence
  Description of Artificial Sequence: Synthetic polypeptide
RVTMSVDRSKNQFSLNLNSVTAADTAVYYC

SEQ ID NO: 2908 - protein, 23 aa, Artificial Sequence
  Description of Artificial Sequence: Synthetic peptide
AARIRGATHYDFWSGFWAGPFDI

SEQ ID NO: 2909 - protein, 11 aa, Artificial Sequence
  Description of Artificial Sequence: Synthetic peptide
WGQGTTVTVSS

SEQ ID NO: 2910 - DNA, 390 bp, Artificial Sequence
  Description of Artificial Sequence: Synthetic polynucleotide
caggtgcagctgcaggagtcgggcccaggactggtgaagccttcggggaccctgtccctcacctgcgctgtctctggtggctccatcagcagtagtgactggtgcagttgggtccgccagcccccagggaaggggccggagtggattgcggaaatctctcatagtgggagcaccaactacaacccgtccctcaagagtcgagtcaccatgtcagtagacagatccaagaaccagttctccctgaacctgaactctgtgaccgccgcggacacggccgtgtattactgtgccgcgagaatccgtggggccacccattacgatttttggagtggtttctgggcgggtccttttgatatctggggccaggggaccacggtcaccgtctcctca

SEQ ID NO: 2911 - skipped

SEQ ID NO: 2912 - protein, 109 aa, Artificial Sequence
  Description of Artificial Sequence: Synthetic polypeptide
ETTLTQSPGTLSLSPGERATLSCRASQSIGSSYLAWYQQKPGQAPRLLIYGASSRATGIPDRFSGSGSGTDFTLTISRLEPEDFAVYYCQQYGSAPLYTFGQGTKVEIK

SEQ ID NO: 2913 - protein, 23 aa, Artificial Sequence
  Description of Artificial Sequence: Synthetic peptide
ETTLTQSPGTLSLSPGERATLSC

SEQ ID NO: 2914 - protein, 12 aa, Artificial Sequence
  Description of Artificial Sequence: Synthetic peptide
RASQSIGSSYLA

SEQ ID NO: 2915 - protein, 15 aa, Artificial Sequence
  Description of Artificial Sequence: Synthetic peptide
WYQQKPGQAPRLLIY

SEQ ID NO: 2916 - protein, 7 aa, Artificial Sequence
  Description of Artificial Sequence: Synthetic peptide
GASSRAT

SEQ ID NO: 2917 - protein, 32 aa, Artificial Sequence
  Description of Artificial Sequence: Synthetic polypeptide
GIPDRFSGSGSGTDFTLTISRLEPEDFAVYYC

SEQ ID NO: 2918 - protein, 10 aa, Artificial Sequence
  Description of Artificial Sequence: Synthetic peptide
QQYGSAPLYT

SEQ ID NO: 2919 - protein, 10 aa, Artificial Sequence
  Description of Artificial Sequence: Synthetic peptide
FGQGTKVEIK

SEQ ID NO: 2920 - DNA, 327 bp, Artificial Sequence
  Description of Artificial Sequence: Synthetic polynucleotide
gaaacgacactcacgcagtctccaggcaccctgtctttgtctccaggggaaagagccaccctctcctgcagggccagtcagagtattggcagcagttacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtacggtagcgcacctctgtacacttttggccaggggaccaaggtggaaatcaaa

SEQ ID NO: 2921-3001 - skipped (81 entries)

SEQ ID NO: 3002 - protein, 129 aa, Artificial Sequence
  Description of Artificial Sequence: Synthetic polypeptide
VQAARKSGAEVRKPGVSVKLSCKASGGTFSTHAISWVRQAPGQRPEWMGGIIPIFGESKDTQKFQGRVTFTADESTTTAYMELRSLRSDDTAIYYCVRDSDPYTTTFSHNHYWYAMDVWGQGTTVTVSS

SEQ ID NO: 3003 - protein, 26 aa, Artificial Sequence
  Description of Artificial Sequence: Synthetic peptide
VQAARKSGAEVRKPGVSVKLSCKASG

SEQ ID NO: 3004 - protein, 9 aa, Artificial Sequence
  Description of Artificial Sequence: Synthetic peptide
GTFSTHAIS

SEQ ID NO: 3005 - protein, 14 aa, Artificial Sequence
  Description of Artificial Sequence: Synthetic peptide
WVRQAPGQRPEWMG

SEQ ID NO: 3006 - protein, 17 aa, Artificial Sequence
  Description of Artificial Sequence: Synthetic peptide
GIIPIFGESKDTQKFQG

SEQ ID NO: 3007 - protein, 30 aa, Artificial Sequence; identical to SEQ ID NO: 1307
  Description of Artificial Sequence: Synthetic polypeptide

SEQ ID NO: 3008 - protein, 22 aa, Artificial Sequence
  Description of Artificial Sequence: Synthetic peptide
VRDSDPYTTTFSHNHYWYAMDV

SEQ ID NO: 3009 - protein, 11 aa, Artificial Sequence
  Description of Artificial Sequence: Synthetic peptide
WGQGTTVTVSS

SEQ ID NO: 3010 - DNA, 387 bp, Artificial Sequence
  Description of Artificial Sequence: Synthetic polynucleotide
gtgcaagctgcaaggaagtctggggctgaggtgaggaagcctggggtctcggtgaagctctcctgcaaggcttctggaggcactttcagcactcatgctatcagttgggtgcggcaggcccctggacaacggcctgagtggatgggagggatcattcctatttttggtgagtcaaaagacacacagaagtttcaaggcagagtcacctttaccgcggacgaatccacgactacagcctacatggagttgaggagcctaagatctgacgacacggccatatattattgtgtgagagactcagacccctacacgacgacttttagccataatcactattggtatgctatggacgtctggggccaggggaccacggtcaccgtctcttca

SEQ ID NO: 3011 - skipped

SEQ ID NO: 3012 - protein, 112 aa, Artificial Sequence
  Description of Artificial Sequence: Synthetic polypeptide
DTTLTQTPLSLPVTLGQPASISCRSSQRLVHSDGNTYLNWFQQRPGQSPRRLIYKVSNRDSGVPDRFSGSGSGTDFTLKISRVEAEDIGVYYCMQGTEWPRTFGQGTKVEIK

SEQ ID NO: 3013 - protein, 23 aa, Artificial Sequence
  Description of Artificial Sequence: Synthetic peptide
DTTLTQTPLSLPVTLGQPASISC

SEQ ID NO: 3014 - protein, 16 aa, Artificial Sequence
  Description of Artificial Sequence: Synthetic peptide
RSSQRLVHSDGNTYLN

SEQ ID NO: 3015 - protein, 15 aa, Artificial Sequence
  Description of Artificial Sequence: Synthetic peptide
WFQQRPGQSPRRLIY

SEQ ID NO: 3016 - protein, 7 aa, Artificial Sequence
  Description of Artificial Sequence: Synthetic peptide
KVSNRDS

SEQ ID NO: 3017 - protein, 32 aa, Artificial Sequence; identical to SEQ ID NO: 1317
  Description of Artificial Sequence: Synthetic polypeptide

SEQ ID NO: 3018 - protein, 9 aa, Artificial Sequence
  Description of Artificial Sequence: Synthetic peptide
MQGTEWPRT

SEQ ID NO: 3019 - protein, 10 aa, Artificial Sequence
  Description of Artificial Sequence: Synthetic peptide
FGQGTKVEIK

SEQ ID NO: 3020 - DNA, 336 bp, Artificial Sequence
  Description of Artificial Sequence: Synthetic polynucleotide
gatacgacactgacgcagactccactctccctgcccgtcacccttggacagccggcctccatctcctgcaggtctagtcaacgcctcgtacacagtgatggaaacacctacttgaattggtttcagcagaggccaggccaatctccaaggcgcctcatttataaggtttctaaccgggactctggggtcccagacagattcagcggcagtgggtcaggcactgacttcacactgaaaatcagcagggtggaggctgaggacattggagtttattactgcatgcaaggtacagagtggcctcggacttttggccaggggaccaaggtggaaatcaaa

SEQ ID NO: 3021-3101 - skipped (81 entries)

SEQ ID NO: 3102 - protein, 126 aa, Artificial Sequence
  Description of Artificial Sequence: Synthetic polypeptide
EVQLQESGPGLVKPSGTLSLTCGVSGVSISSSSWWSWVRQPPGRGLEWIGEISPSGSTSYNPSFRSRLTMSVDKSRNQLSLKLSSVTAADTAVYYCARTQSNDFWSGYYTAAFDLWGQGTMVTVSS

SEQ ID NO: 3103 - protein, 26 aa, Artificial Sequence
  Description of Artificial Sequence: Synthetic peptide
EVQLQESGPGLVKPSGTLSLTCGVSG

SEQ ID NO: 3104 - protein, 10 aa, Artificial Sequence
  Description of Artificial Sequence: Synthetic peptide
VSISSSSWWS

SEQ ID NO: 3105 - protein, 14 aa, Artificial Sequence
  Description of Artificial Sequence: Synthetic peptide
WVRQPPGRGLEWIG

SEQ ID NO: 3106 - protein, 16 aa, Artificial Sequence
  Description of Artificial Sequence: Synthetic peptide
EISPSGSTSYNPSFRS

SEQ ID NO: 3107 - protein, 30 aa, Artificial Sequence
  Description of Artificial Sequence: Synthetic polypeptide
RLTMSVDKSRNQLSLKLSSVTAADTAVYYC

SEQ ID NO: 3108 - protein, 19 aa, Artificial Sequence
  Description of Artificial Sequence: Synthetic peptide
ARTQSNDFWSGYYTAAFDL

SEQ ID NO: 3109 - protein, 11 aa, Artificial Sequence
  Description of Artificial Sequence: Synthetic peptide
WGQGTMVTVSS

SEQ ID NO: 3110 - DNA, 378 bp, Artificial Sequence
  Description of Artificial Sequence: Synthetic polynucleotide
gaggtgcagctgcaggagtcgggcccaggactggtgaagccttcggggaccctgtccctcacctgcggtgtctctggtgtctccatcagtagtagtagctggtggagttgggtccgccagcccccagggagggggctggagtggattggggaaatctctcctagtgggagcaccagttacaacccgtccttcaggagtcgactcaccatgtcagtagacaagtcgaggaatcagctctccctgaaactgagttctgtgaccgccgcggacacggccgtctattactgtgcgagaacccagtcgaacgatttttggagtggttattatacggcggcttttgatctctggggccaagggacaatggtcaccgtctcctca

SEQ ID NO: 3111 - skipped

SEQ ID NO: 3112 - protein, 108 aa, Artificial Sequence
  Description of Artificial Sequence: Synthetic polypeptide
EIVLTQSPGTLSLSPGERASLSCRASQSVSSSYLAWYQHRPGQAPRLLIYDASSRATGIPDRFSGSGSGTDFTLTISRLESEDFAVYYCQQYGNSPRTFGQGTKVDIK

SEQ ID NO: 3113 - protein, 23 aa, Artificial Sequence
  Description of Artificial Sequence: Synthetic peptide
EIVLTQSPGTLSLSPGERASLSC

SEQ ID NO: 3114 - protein, 12 aa, Artificial Sequence
  Description of Artificial Sequence: Synthetic peptide
RASQSVSSSYLA

SEQ ID NO: 3115 - protein, 15 aa, Artificial Sequence
  Description of Artificial Sequence: Synthetic peptide
WYQHRPGQAPRLLIY

SEQ ID NO: 3116 - protein, 7 aa, Artificial Sequence
  Description of Artificial Sequence: Synthetic peptide
DASSRAT

SEQ ID NO: 3117 - protein, 32 aa, Artificial Sequence
  Description of Artificial Sequence: Synthetic polypeptide
GIPDRFSGSGSGTDFTLTISRLESEDFAVYYC

SEQ ID NO: 3118 - protein, 9 aa, Artificial Sequence
  Description of Artificial Sequence: Synthetic peptide
QQYGNSPRT

SEQ ID NO: 3119 - protein, 10 aa, Artificial Sequence
  Description of Artificial Sequence: Synthetic peptide
FGQGTKVDIK

SEQ ID NO: 3120 - DNA, 324 bp, Artificial Sequence
  Description of Artificial Sequence: Synthetic polynucleotide
gaaattgtgttgacgcagtctccaggcaccctgtctttgtctccaggggaaagagcctccctctcctgcagggccagtcagagtgttagcagcagttacttagcctggtaccagcacagacctggccaggctcccaggctcctcatctatgatgcatccagcagggccactggcatcccagacaggttcagtggcagtgggtctgggacagacttcactctcaccatcagcagactggagtctgaagattttgcagtgtattactgtcagcagtatggtaactcaccaagaacgttcggccaagggaccaaagtggatatcaaa

SEQ ID NO: 3121-3201 - skipped (81 entries)

SEQ ID NO: 3202 - protein, 129 aa, Artificial Sequence
  Description of Artificial Sequence: Synthetic polypeptide
QVQLVQWGAGLLKPSETLSLTCAVYGGSFSGFHWSWIRQPPGKGLEWIGEINHSGSTKYNPSLKSRVTISVDTSKNQFSLRLRSVTAADTAIYYCARGSLSREYDFLTAPQNGPWFDSWGQGALVTVSS

SEQ ID NO: 3203 - protein, 26 aa, Artificial Sequence
  Description of Artificial Sequence: Synthetic peptide
QVQLVQWGAGLLKPSETLSLTCAVYG

SEQ ID NO: 3204 - protein, 9 aa, Artificial Sequence
  Description of Artificial Sequence: Synthetic peptide
GSFSGFHWS

SEQ ID NO: 3205 - protein, 14 aa, Artificial Sequence
  Description of Artificial Sequence: Synthetic peptide
WIRQPPGKGLEWIG

SEQ ID NO: 3206 - protein, 16 aa, Artificial Sequence
  Description of Artificial Sequence: Synthetic peptide
EINHSGSTKYNPSLKS

SEQ ID NO: 3207 - protein, 30 aa, Artificial Sequence
  Description of Artificial Sequence: Synthetic polypeptide
RVTISVDTSKNQFSLRLRSVTAADTAIYYC

SEQ ID NO: 3208 - protein, 23 aa, Artificial Sequence
  Description of Artificial Sequence: Synthetic peptide
ARGSLSREYDFLTAPQNGPWFDS

SEQ ID NO: 3209 - protein, 11 aa, Artificial Sequence
  Description of Artificial Sequence: Synthetic peptide
WGQGALVTVSS

SEQ ID NO: 3210 - DNA, 387 bp, Artificial Sequence
  Description of Artificial Sequence: Synthetic polynucleotide
caggtccagctggtacagtggggcgcaggactgttgaagccttcggagaccctgtccctcacctgcgctgtctatggtgggtccttcagtggtttccactggagctggatccgccagcccccagggaaggggctggagtggattggggaaatcaatcatagtggcagcaccaagtacaacccgtccctcaagagtcgagtcaccatatcagtagacacgtccaagaaccagttctccctgaggctgaggtctgtgaccgccgcggacacggctatatattactgtgcgagagggtcgctttcgagagaatacgactttttgactgctccccaaaatgggccgtggttcgactcctggggccagggagccctggtcaccgtctcctca

SEQ ID NO: 3211 - skipped

SEQ ID NO: 3212 - protein, 110 aa, Artificial Sequence
  Description of Artificial Sequence: Synthetic polypeptide
QPVLTQPPSVSAAPGQKVTISCSGSSSNIGDNYVSWYQQLPGTAPKLLIYDNNKRPSGIPDRFSGSKSGTSATLGITGLQTGDEADYYCETWDTSLSVVVFGGGTKLTVL

SEQ ID NO: 3213 - protein, 22 aa, Artificial Sequence
  Description of Artificial Sequence: Synthetic peptide
QPVLTQPPSVSAAPGQKVTISC

SEQ ID NO: 3214 - protein, 13 aa, Artificial Sequence
  Description of Artificial Sequence: Synthetic peptide
SGSSSNIGDNYVS

SEQ ID NO: 3215 - protein, 15 aa, Artificial Sequence
  Description of Artificial Sequence: Synthetic peptide
WYQQLPGTAPKLLIY

SEQ ID NO: 3216 - protein, 7 aa, Artificial Sequence
  Description of Artificial Sequence: Synthetic peptide
DNNKRPS

SEQ ID NO: 3217 - protein, 32 aa, Artificial Sequence; identical to SEQ ID NO: 2117
  Description of Artificial Sequence: Synthetic polypeptide

SEQ ID NO: 3218 - protein, 11 aa, Artificial Sequence
  Description of Artificial Sequence: Synthetic peptide
ETWDTSLSVVV

SEQ ID NO: 3219 - protein, 10 aa, Artificial Sequence
  Description of Artificial Sequence: Synthetic peptide
FGGGTKLTVL

SEQ ID NO: 3220 - DNA, 330 bp, Artificial Sequence
  Description of Artificial Sequence: Synthetic polynucleotide
cagcctgtgctgactcagccaccctcagtgtctgcggccccaggacagaaggtcaccatctcctgctctggaagcagctccaacattggggataattatgtctcctggtaccagcagctcccaggaacagcccccaaacttctcatttatgacaataataagcgaccctcagggattcctgaccgattctctggctccaagtctggcacgtcagccaccctgggcatcaccggactccagactggggacgaggccgattattactgcgaaacatgggataccagcctgagtgttgtggttttcggcggagggaccaagctgaccgtccta

SEQ ID NO: 3221-3301 - skipped (81 entries)

SEQ ID NO: 3302 - protein, 124 aa, Artificial Sequence
  Description of Artificial Sequence: Synthetic polypeptide
EVQLVESGPELKKPGSSVRVSCKASGGSFSNFAVSWVRQAPGQRLEWMGGVIPRFGRSEYVQKFQGRVTITVDEAASTAYMELSSLRSEDTAIYYCVLDTTSANPHNWYGMDVWGQGTTVTVSS

SEQ ID NO: 3303 - protein, 26 aa, Artificial Sequence
  Description of Artificial Sequence: Synthetic peptide
EVQLVESGPELKKPGSSVRVSCKASG

SEQ ID NO: 3304 - protein, 9 aa, Artificial Sequence
  Description of Artificial Sequence: Synthetic peptide
GSFSNFAVS

SEQ ID NO: 3305 - protein, 14 aa, Artificial Sequence
  Description of Artificial Sequence: Synthetic peptide
WVRQAPGQRLEWMG

SEQ ID NO: 3306 - protein, 17 aa, Artificial Sequence
  Description of Artificial Sequence: Synthetic peptide
GVIPRFGRSEYVQKFQG

SEQ ID NO: 3307 - protein, 30 aa, Artificial Sequence
  Description of Artificial Sequence: Synthetic polypeptide
RVTITVDEAASTAYMELSSLRSEDTAIYYC

SEQ ID NO: 3308 - protein, 17 aa, Artificial Sequence
  Description of Artificial Sequence: Synthetic peptide
VLDTTSANPHNWYGMDV

SEQ ID NO: 3309 - protein, 11 aa, Artificial Sequence
  Description of Artificial Sequence: Synthetic peptide
WGQGTTVTVSS

SEQ ID NO: 3310 - DNA, 372 bp, Artificial Sequence
  Description of Artificial Sequence: Synthetic polynucleotide
gaggtgcagctggtggagtctgggcctgaactgaagaagcccgggtcctcggtgagagtttcctgcaaggcttctggaggctccttcagcaattttgctgtcagctgggtgcgacaggcccctggacaacggcttgagtggatgggaggagtcatccctcgctttggtagatcagagtatgtgcagaagttccagggcagagtcaccattaccgtggacgaagccgcgagcacagcctacatggaactgagcagcctgagatctgaagacacggccatctattactgtgtcttagacacaacttcggcaaacccgcacaattggtacggtatggacgtctggggccaagggaccacggtcaccgtctcttca

SEQ ID NO: 3311 - skipped

SEQ ID NO: 3312 - protein, 112 aa, Artificial Sequence
  Description of Artificial Sequence: Synthetic polypeptide
DIVMTQTPLSLAVTLGQPASISCRSSHGLVHTNGNTYLNWFHQRPGQPPRRLIYKISNRDSGVPDRFSGSGSGTDFTLKISRVEADDVGVYYCMQGTDWPRTFGQGTKVEIK

SEQ ID NO: 3313 - protein, 23 aa, Artificial Sequence
  Description of Artificial Sequence: Synthetic peptide
DIVMTQTPLSLAVTLGQPASISC

SEQ ID NO: 3314 - protein, 16 aa, Artificial Sequence
  Description of Artificial Sequence: Synthetic peptide
RSSHGLVHTNGNTYLN

SEQ ID NO: 3315 - protein, 15 aa, Artificial Sequence
  Description of Artificial Sequence: Synthetic peptide
WFHQRPGQPPRRLIY

SEQ ID NO: 3316 - protein, 7 aa, Artificial Sequence
  Description of Artificial Sequence: Synthetic peptide
KISNRDS

SEQ ID NO: 3317 - protein, 32 aa, Artificial Sequence
  Description of Artificial Sequence: Synthetic polypeptide
GVPDRFSGSGSGTDFTLKISRVEADDVGVYYC

SEQ ID NO: 3318 - protein, 9 aa, Artificial Sequence
  Description of Artificial Sequence: Synthetic peptide
MQGTDWPRT

SEQ ID NO: 3319 - protein, 10 aa, Artificial Sequence
  Description of Artificial Sequence: Synthetic peptide
FGQGTKVEIK

SEQ ID NO: 3320 - DNA, 336 bp, Artificial Sequence
  Description of Artificial Sequence: Synthetic polynucleotide
gatattgtgatgactcagactccactctccctggccgtcacccttggacagccggcctccatctcctgcaggtctagtcacggcctcgtacacactaatggaaacacttacttgaattggtttcaccagaggccaggccagcctccaaggcgcctaatttataagatttctaaccgggactctggggtcccagacagattcagcggcagtgggtcaggcactgacttcacactgaaaatcagcagggtggaggctgacgatgttggggtttattactgcatgcagggtacagactggcctcggacgttcggccaagggaccaaggtggaaatcaaa

SEQ ID NO: 3321-3401 - skipped (81 entries)

SEQ ID NO: 3402 - protein, 120 aa, Artificial Sequence
  Description of Artificial Sequence: Synthetic polypeptide
QVQLVQSGGGVVNPGGSLRLSCVGSGFTFSDYYMGWIRQAPGKGLEVISYISSTGSYIRDADSVKGRFTISRDNAENSVYLQMNSLRGEDTAVYYCARMGPYGSGSFDYWGLGTLVTVSS

SEQ ID NO: 3403 - protein, 26 aa, Artificial Sequence
  Description of Artificial Sequence: Synthetic peptide
QVQLVQSGGGVVNPGGSLRLSCVGSG

SEQ ID NO: 3404 - protein, 9 aa, Artificial Sequence
  Description of Artificial Sequence: Synthetic peptide
FTFSDYYMG

SEQ ID NO: 3405 - protein, 14 aa, Artificial Sequence
  Description of Artificial Sequence: Synthetic peptide
WIRQAPGKGLEVIS

SEQ ID NO: 3406 - protein, 17 aa, Artificial Sequence
  Description of Artificial Sequence: Synthetic peptide
YISSTGSYIRDADSVKG

SEQ ID NO: 3407 - protein, 30 aa, Artificial Sequence
  Description of Artificial Sequence: Synthetic polypeptide
RFTISRDNAENSVYLQMNSLRGEDTAVYYC

SEQ ID NO: 3408 - protein, 13 aa, Artificial Sequence
  Description of Artificial Sequence: Synthetic peptide
ARMGPYGSGSFDY

SEQ ID NO: 3409 - protein, 11 aa, Artificial Sequence
  Description of Artificial Sequence: Synthetic peptide
WGLGTLVTVSS

SEQ ID NO: 3410 - DNA, 360 bp, Artificial Sequence
  Description of Artificial Sequence: Synthetic polynucleotide
caggtccagctggtacagtctgggggaggcgtggtcaaccctggagggtccctgagactctcctgtgtaggctctggattcactttcagtgactactacatgggttggatccgccaggctccagggaaggggctggaggtgatttcatacattagttctactgggtcctatataagggacgcagactctgtgaagggccgattcaccatctcccgagacaacgccgagaattcagtgtatctgcaaatgaacagcctgagaggcgaggacacggctgtctattactgtgcgagaatgggcccctatggttcggggagttttgactactggggcctgggaaccctggtcaccgtctcctca

SEQ ID NO: 3411 - skipped

SEQ ID NO: 3412 - protein, 107 aa, Artificial Sequence
  Description of Artificial Sequence: Synthetic polypeptide
EIVLTQSPGTLSLSPGERATLSCRASQTVTRSQLAWYQHKPGQPPRLLIYDSSKRATGSPDRFSASGSGTDFTLTISGLEPEDTGIYYCLQYSDATTFGPGTKLEIK

SEQ ID NO: 3413 - protein, 23 aa, Artificial Sequence
  Description of Artificial Sequence: Synthetic peptide
EIVLTQSPGTLSLSPGERATLSC

SEQ ID NO: 3414 - protein, 12 aa, Artificial Sequence
  Description of Artificial Sequence: Synthetic peptide
RASQTVTRSQLA

SEQ ID NO: 3415 - protein, 15 aa, Artificial Sequence
  Description of Artificial Sequence: Synthetic peptide
WYQHKPGQPPRLLIY

SEQ ID NO: 3416 - protein, 7 aa, Artificial Sequence
  Description of Artificial Sequence: Synthetic peptide
DSSKRAT

SEQ ID NO: 3417 - protein, 32 aa, Artificial Sequence
  Description of Artificial Sequence: Synthetic polypeptide
GSPDRFSASGSGTDFTLTISGLEPEDTGIYYC

SEQ ID NO: 3418 - protein, 8 aa, Artificial Sequence
  Description of Artificial Sequence: Synthetic peptide
LQYSDATT

SEQ ID NO: 3419 - protein, 10 aa, Artificial Sequence
  Description of Artificial Sequence: Synthetic peptide
FGPGTKLEIK

SEQ ID NO: 3420 - DNA, 321 bp, Artificial Sequence
  Description of Artificial Sequence: Synthetic polynucleotide
gaaattgtgttgacgcagtctccaggcaccctgtctttgtctccaggggagagagccaccctctcctgcagggccagtcagactgttactagaagccaattagcctggtaccagcacaaacctggccagcctcccaggctcctcatctatgattcatccaaaagggccactggttccccagacaggttcagtgccagtgggtctgggactgacttcaccctcactattagtggattggagcctgaagatactgggatttattactgtctccagtatagtgacgcaacgacgttcggcccagggaccaagctggagatcaaa

SEQ ID NO: 3421-3501 - skipped (81 entries)

SEQ ID NO: 3502 - protein, 126 aa, Artificial Sequence
  Description of Artificial Sequence: Synthetic polypeptide
PGPACTVWAEVKKPGSSVKVSCKASGGMFSDYAISWVRQAPGQRLEWMGGIMPGLGSPGYAQIFRGRATISADVSTSTAYLELTSLKPEDTAVYYCARDPSILNTGNHHWYDLDIWGQGTQVTVSS

SEQ ID NO: 3503 - protein, 26 aa, Artificial Sequence
  Description of Artificial Sequence: Synthetic peptide
PGPACTVWAEVKKPGSSVKVSCKASG

SEQ ID NO: 3504 - protein, 9 aa, Artificial Sequence
  Description of Artificial Sequence: Synthetic peptide
GMFSDYAIS

SEQ ID NO: 3505 - protein, 14 aa, Artificial Sequence
  Description of Artificial Sequence: Synthetic peptide
WVRQAPGQRLEWMG

SEQ ID NO: 3506 - protein, 17 aa, Artificial Sequence
  Description of Artificial Sequence: Synthetic peptide
GIMPGLGSPGYAQIFRG

SEQ ID NO: 3507 - protein, 30 aa, Artificial Sequence
  Description of Artificial Sequence: Synthetic polypeptide
RATISADVSTSTAYLELTSLKPEDTAVYYC

SEQ ID NO: 3508 - protein, 19 aa, Artificial Sequence
  Description of Artificial Sequence: Synthetic peptide
ARDPSILNTGNHHWYDLDI

SEQ ID NO: 3509 - protein, 11 aa, Artificial Sequence
  Description of Artificial Sequence: Synthetic peptide
WGQGTQVTVSS

SEQ ID NO: 3510 - DNA, 378 bp, Artificial Sequence
  Description of Artificial Sequence: Synthetic polynucleotide
ccaggtccagcttgtacagtctgggctgaggtgaagaagcctgggtcgtcggtgaaggtctcctgcaaggcttctggaggcatgttcagtgactatgccatcagttgggtgcgacaggcccctggacaacgacttgagtggatgggagggatcatgcctggccttggttcgccaggctacgcacagatttttcggggcagagccaccatttccgcggacgtttccacgagcacggcctacttggaattgaccagcctgaagcctgaggacacggccgtgtattattgtgcgagagacccgtctattcttaacactgggaatcaccactggtatgatttagatatctggggccaagggacacaggtcaccgtctcctca

SEQ ID NO: 3511 - skipped

SEQ ID NO: 3512 - protein, 112 aa, Artificial Sequence
  Description of Artificial Sequence: Synthetic polypeptide
DIVMTQSPLSLPVGLGQSASISCRSSQRVVHTDGNTYLNWFHQRPGQSPRRLIYKVSNRDSGVPDRFSGSGSGTDFTLRISRVEAEDVGVYYCMQATEWPRTFGQGTKVEIK

SEQ ID NO: 3513 - protein, 23 aa, Artificial Sequence
  Description of Artificial Sequence: Synthetic peptide
DIVMTQSPLSLPVGLGQSASISC

SEQ ID NO: 3514 - protein, 16 aa, Artificial Sequence
  Description of Artificial Sequence: Synthetic peptide
RSSQRVVHTDGNTYLN

SEQ ID NO: 3515 - protein, 15 aa, Artificial Sequence
  Description of Artificial Sequence: Synthetic peptide
WFHQRPGQSPRRLIY

SEQ ID NO: 3516 - protein, 7 aa, Artificial Sequence
  Description of Artificial Sequence: Synthetic peptide
KVSNRDS

SEQ ID NO: 3517 - protein, 32 aa, Artificial Sequence
  Description of Artificial Sequence: Synthetic polypeptide
GVPDRFSGSGSGTDFTLRISRVEAEDVGVYYC

SEQ ID NO: 3518 - protein, 9 aa, Artificial Sequence
  Description of Artificial Sequence: Synthetic peptide
MQATEWPRT

SEQ ID NO: 3519 - protein, 10 aa, Artificial Sequence
  Description of Artificial Sequence: Synthetic peptide
FGQGTKVEIK

SEQ ID NO: 3520 - DNA, 336 bp, Artificial Sequence
  Description of Artificial Sequence: Synthetic polynucleotide
gatattgtgatgactcagtctccactctccctgcccgtcggcctcggacagtcggcctccatctcctgcaggtctagtcaaagggtcgtacacactgatgggaacacctacttgaattggtttcaccagaggccaggccaatctccaaggcgcctcatttataaggtttctaaccgggactccggggtcccagacagattcagcggcagtgggtcaggcactgatttcaccctgagaatcagcagggtggaggctgaggatgttggcgtttattactgcatgcaagctacagagtggcctcggacgttcggccaagggaccaaggtggaaatcaaa

SEQ ID NO: 3521-3601 - skipped (81 entries)

SEQ ID NO: 3602 - protein, 122 aa, Artificial Sequence
  Description of Artificial Sequence: Synthetic polypeptide
QVQLVQSGAEVKKPGSSVKVSCKASGGTSSTHAISWVRQAPGQGLEWMGGIIPIFGTTNYAQKFQDRVTITADESTSTAYMELSSLRSEDTAVYFCVRDGAYDSSGYYSTQWGQGTLVTVSS

SEQ ID NO: 3603 - protein, 26 aa, Artificial Sequence
  Description of Artificial Sequence: Synthetic peptide
QVQLVQSGAEVKKPGSSVKVSCKASG

SEQ ID NO: 3604 - protein, 9 aa, Artificial Sequence
  Description of Artificial Sequence: Synthetic peptide
GTSSTHAIS

SEQ ID NO: 3605 - protein, 14 aa, Artificial Sequence
  Description of Artificial Sequence: Synthetic peptide
WVRQAPGQGLEWMG

SEQ ID NO: 3606 - protein, 17 aa, Artificial Sequence
  Description of Artificial Sequence: Synthetic peptide
GIIPIFGTTNYAQKFQD

SEQ ID NO: 3607 - protein, 30 aa, Artificial Sequence
  Description of Artificial Sequence: Synthetic polypeptide
RVTITADESTSTAYMELSSLRSEDTAVYFC

SEQ ID NO: 3608 - protein, 15 aa, Artificial Sequence
  Description of Artificial Sequence: Synthetic peptide
VRDGAYDSSGYYSTQ

SEQ ID NO: 3609 - protein, 11 aa, Artificial Sequence
  Description of Artificial Sequence: Synthetic peptide
WGQGTLVTVSS

SEQ ID NO: 3610 - DNA, 366 bp, Artificial Sequence
  Description of Artificial Sequence: Synthetic polynucleotide
caggtccagctggtgcagtctggggctgaggtgaagaagcctgggtcctcggtgaaggtctcctgcaaggcttctggaggcacctccagcacccatgctatcagctgggtgcgacaggcccctggacaagggcttgagtggatgggagggatcatccctatctttggtacaacaaactacgcacagaagttccaggacagagtcacgattaccgcggacgaatccacgagcacagcctacatggaactgagtagcctgagatctgaagacacggccgtatatttctgtgtgagagatggtgcctatgatagcagtggttattattccacccaatggggccagggaaccctggtcaccgtctcttca

SEQ ID NO: 3611 - skipped

SEQ ID NO: 3612 - protein, 109 aa, Artificial Sequence
  Description of Artificial Sequence: Synthetic polypeptide
EIVLTQSPATLSLSPGERATLSCRASQSVSNFLAWYQQKPGQPPRLLIYDASNRASGIAARFSGRGSGTDFTLTISSLEPEDFAVYYCQQRRNWPPMYTFGQGTKLEIK

SEQ ID NO: 3613 - protein, 23 aa, Artificial Sequence
  Description of Artificial Sequence: Synthetic peptide
EIVLTQSPATLSLSPGERATLSC

SEQ ID NO: 3614 - protein, 11 aa, Artificial Sequence
  Description of Artificial Sequence: Synthetic peptide
RASQSVSNFLA

SEQ ID NO: 3615 - protein, 15 aa, Artificial Sequence
  Description of Artificial Sequence: Synthetic peptide
WYQQKPGQPPRLLIY

SEQ ID NO: 3616 - protein, 7 aa, Artificial Sequence
  Description of Artificial Sequence: Synthetic peptide
DASNRAS

SEQ ID NO: 3617 - protein, 32 aa, Artificial Sequence
  Description of Artificial Sequence: Synthetic polypeptide
GIAARFSGRGSGTDFTLTISSLEPEDFAVYYC

SEQ ID NO: 3618 - protein, 11 aa, Artificial Sequence
  Description of Artificial Sequence: Synthetic peptide
QQRRNWPPMYT

SEQ ID NO: 3619 - protein, 10 aa, Artificial Sequence
  Description of Artificial Sequence: Synthetic peptide
FGQGTKLEIK

SEQ ID NO: 3620 - DNA, 327 bp, Artificial Sequence
  Description of Artificial Sequence: Synthetic polynucleotide
gaaattgtattgacacagtctccagccaccctgtctttgtctccaggggaaagagccaccctctcctgcagggccagtcagagcgttagcaacttcttagcctggtaccaacaaaaacctggccagcctcccaggctcctcatctatgatgcatccaacagggcctctggcatcgcagccaggttcagtggccgtgggtctgggacagacttcactctcaccatcagcagcctagagcctgaagattttgcagtttattactgtcagcagcgtcgcaactggcctccgatgtacacttttggccaggggaccaagctggagatcaaa

SEQ ID NO: 3621-3701 - skipped (81 entries)

SEQ ID NO: 3702 - protein, 126 aa, Artificial Sequence
  Description of Artificial Sequence: Synthetic polypeptide
EVQLVQSGAEVKKPGSSVKVSCKVSGGRFSDYAISWLRQAPVKGLEWMGGIIPRLNRKGYSQDFQGRLTFTADESTSTAYMELSGLTSEDTAVYYCARDPTFLNSGNHFWYAVDIWGQGTTVTVSS

SEQ ID NO: 3703 - protein, 26 aa, Artificial Sequence
  Description of Artificial Sequence: Synthetic peptide
EVQLVQSGAEVKKPGSSVKVSCKVSG

SEQ ID NO: 3704 - protein, 9 aa, Artificial Sequence
  Description of Artificial Sequence: Synthetic peptide
GRFSDYAIS

SEQ ID NO: 3705 - protein, 14 aa, Artificial Sequence
  Description of Artificial Sequence: Synthetic peptide
WLRQAPVKGLEWMG

SEQ ID NO: 3706 - protein, 17 aa, Artificial Sequence
  Description of Artificial Sequence: Synthetic peptide
GIIPRLNRKGYSQDFQG

SEQ ID NO: 3707 - protein, 30 aa, Artificial Sequence
  Description of Artificial Sequence: Synthetic polypeptide
RLTFTADESTSTAYMELSGLTSEDTAVYYC

SEQ ID NO: 3708 - protein, 19 aa, Artificial Sequence
  Description of Artificial Sequence: Synthetic peptide
ARDPTFLNSGNHFWYAVDI

SEQ ID NO: 3709 - protein, 11 aa, Artificial Sequence
  Description of Artificial Sequence: Synthetic peptide
WGQGTTVTVSS

SEQ ID NO: 3710 - DNA, 378 bp, Artificial Sequence
  Description of Artificial Sequence: Synthetic polynucleotide
gaggtgcagcttgtacagtctggggctgaagtgaagaagcctgggtcctcggtgaaggtctcctgtaaggtttccggagggagattcagtgattacgctatcagctggctgcgacaggcccccgtaaaaggactcgagtggatggggggaatcatccctcgtctaaatagaaaaggatactcacaggatttccagggcagactcacctttactgcggacgagtccaccagcaccgcctacatggaattgagtggcctgacgtctgaagacacggccgtttattactgtgcaagagatccgacttttcttaacagtggaaatcacttctggtatgctgttgatatctggggccaagggacaacggtcaccgtctcctca

SEQ ID NO: 3711 - skipped

SEQ ID NO: 3712 - protein, 112 aa, Artificial Sequence
  Description of Artificial Sequence: Synthetic polypeptide
EIVLTQSPLSLSVTLGQAASISCTCSQTAVHSDGNTYLNWFHQRPGQSPRRLIYKVSNRDSGVPDRFSGSGSGTDFTLKISRVEAEDVGIYYCMQTTDWPRTFGQGTKLEIK

SEQ ID NO: 3713 - protein, 23 aa, Artificial Sequence
  Description of Artificial Sequence: Synthetic peptide
EIVLTQSPLSLSVTLGQAASISC

SEQ ID NO: 3714 - protein, 16 aa, Artificial Sequence
  Description of Artificial Sequence: Synthetic peptide
TCSQTAVHSDGNTYLN

SEQ ID NO: 3715 - protein, 15 aa, Artificial Sequence
  Description of Artificial Sequence: Synthetic peptide
WFHQRPGQSPRRLIY

SEQ ID NO: 3716 - protein, 7 aa, Artificial Sequence
  Description of Artificial Sequence: Synthetic peptide
KVSNRDS

SEQ ID NO: 3717 - protein, 32 aa, Artificial Sequence; identical to SEQ ID NO: 1517
  Description of Artificial Sequence: Synthetic polypeptide

SEQ ID NO: 3718 - protein, 9 aa, Artificial Sequence
  Description of Artificial Sequence: Synthetic peptide
MQTTDWPRT

SEQ ID NO: 3719 - protein, 10 aa, Artificial Sequence
  Description of Artificial Sequence: Synthetic peptide
FGQGTKLEIK

SEQ ID NO: 3720 - DNA, 336 bp, Artificial Sequence
  Description of Artificial Sequence: Synthetic polynucleotide
gaaattgtgttgacgcagtctccactctccctgtccgtcacccttggacaggcggcctccatctcctgcacctgtagtcaaacggccgtgcactctgatggaaacacctacctgaattggtttcaccagaggccaggccaatctccaaggcgcctcatttataaggtttctaatcgggactctggggtcccagacagattcagcggcagtgggtcaggcactgatttcacactgaaaatcagcagggtggaggctgaggatgttggaatttattactgcatgcaaactacagactggcctcggacgttcggccaagggaccaagctggagatcaaa

SEQ ID NO: 3721-3801 - skipped (81 entries)

SEQ ID NO: 3802 - protein, 126 aa, Artificial Sequence
  Description of Artificial Sequence: Synthetic polypeptide
QVQLVQSGAEVKKPGSSVTVSCKVSGGRFSDYAISWLRQAPVEGLEWMGGIIPHLNKKGYSQKFQDRITFTADESTSTAYMELSGLTSEDTAIYYCARDPTFLNTGNHFWYAVDIWGQGTTVTVSS

SEQ ID NO: 3803 - protein, 26 aa, Artificial Sequence
  Description of Artificial Sequence: Synthetic peptide
QVQLVQSGAEVKKPGSSVTVSCKVSG

SEQ ID NO: 3804 - protein, 9 aa, Artificial Sequence
  Description of Artificial Sequence: Synthetic peptide
GRFSDYAIS

SEQ ID NO: 3805 - protein, 14 aa, Artificial Sequence
  Description of Artificial Sequence: Synthetic peptide
WLRQAPVEGLEWMG

SEQ ID NO: 3806 - protein, 17 aa, Artificial Sequence
  Description of Artificial Sequence: Synthetic peptide
GIIPHLNKKGYSQKFQD

SEQ ID NO: 3807 - protein, 30 aa, Artificial Sequence
  Description of Artificial Sequence: Synthetic polypeptide
RITFTADESTSTAYMELSGLTSEDTAIYYC

SEQ ID NO: 3808 - protein, 19 aa, Artificial Sequence
  Description of Artificial Sequence: Synthetic peptide
ARDPTFLNTGNHFWYAVDI

SEQ ID NO: 3809 - protein, 11 aa, Artificial Sequence
  Description of Artificial Sequence: Synthetic peptide
WGQGTTVTVSS

SEQ ID NO: 3810 - DNA, 378 bp, Artificial Sequence
  Description of Artificial Sequence: Synthetic polynucleotide
caggtccagctggtgcagtctggggctgaagtgaagaagcctgggtcctcggtgacggtctcctgtaaggtttccggagggagattcagtgactacgctattagctggctgcggcaggcccccgtagaaggactcgagtggatggggggaatcatccctcatcttaataaaaaaggatactcacagaagttccaggacagaatcacctttactgcggacgagtccaccagtaccgcctacatggaattgagtggcctgacgtctgaggacacggccatttattactgtgcaagagatccgacttttcttaatactggaaatcacttctggtatgctgttgatatctggggccaagggaccacggtcaccgtctcctca

SEQ ID NO: 3811 - skipped

SEQ ID NO: 3812 - protein, 112 aa, Artificial Sequence
  Description of Artificial Sequence: Synthetic polypeptide
ETTLTQSPLSLSVTLGQAASISCTCSQSAVHSDGNTYFNWFHQRPGQSPRRLIYKVSNRDSGVPERFSGSGSGTHFTLIISRVEAEDVGVYYCMQTTDWPRTFGQGTKVDIK

SEQ ID NO: 3813 - protein, 23 aa, Artificial Sequence
  Description of Artificial Sequence: Synthetic peptide
ETTLTQSPLSLSVTLGQAASISC

SEQ ID NO: 3814 - protein, 16 aa, Artificial Sequence
  Description of Artificial Sequence: Synthetic peptide
TCSQSAVHSDGNTYFN

SEQ ID NO: 3815 - protein, 15 aa, Artificial Sequence
  Description of Artificial Sequence: Synthetic peptide
WFHQRPGQSPRRLIY

SEQ ID NO: 3816 - protein, 7 aa, Artificial Sequence
  Description of Artificial Sequence: Synthetic peptide
KVSNRDS

SEQ ID NO: 3817 - protein, 32 aa, Artificial Sequence
  Description of Artificial Sequence: Synthetic polypeptide
GVPERFSGSGSGTHFTLIISRVEAEDVGVYYC

SEQ ID NO: 3818 - protein, 9 aa, Artificial Sequence
  Description of Artificial Sequence: Synthetic peptide
MQTTDWPRT

SEQ ID NO: 3819 - protein, 10 aa, Artificial Sequence
  Description of Artificial Sequence: Synthetic peptide
FGQGTKVDIK

SEQ ID NO: 3820 - DNA, 336 bp, Artificial Sequence
  Description of Artificial Sequence: Synthetic polynucleotide
gaaacgacactcacgcagtctccactctccctgtccgtcacccttggacaggcggcctccatctcctgcacctgtagtcaatcggccgtgcacagtgatggaaacacctacttcaattggtttcaccagaggccaggccaatctccaaggcgcctcatttataaggtttctaatcgcgactctggggtcccagagagattcagcggcagtggctcaggcactcatttcacactgataatcagcagggtggaggctgaggatgttggggtttactactgcatgcaaacaacagactggcctcggacgttcggccaggggaccaaagtggatatcaaa

SEQ ID NO: 3821-3901 - skipped (81 entries)

SEQ ID NO: 3902 - protein, 127 aa, Artificial Sequence
  Description of Artificial Sequence: Synthetic polypeptide
QVQLVQSGAEVKKPGASVKVSCKASGYTFSLFHVHWVRQAPGQGLEWMGWINPHNGDTTFAERFQGRVALTRDTSINTAYMELSRLTSDDTAVYFCARDFGVRYDDSRQLMKYCDSWGQGTLVTVSS

SEQ ID NO: 3903 - protein, 26 aa, Artificial Sequence
  Description of Artificial Sequence: Synthetic peptide
QVQLVQSGAEVKKPGASVKVSCKASG

SEQ ID NO: 3904 - protein, 9 aa, Artificial Sequence
  Description of Artificial Sequence: Synthetic peptide
YTFSLFHVH

SEQ ID NO: 3905 - protein, 14 aa, Artificial Sequence
  Description of Artificial Sequence: Synthetic peptide
WVRQAPGQGLEWMG

SEQ ID NO: 3906 - protein, 17 aa, Artificial Sequence
  Description of Artificial Sequence: Synthetic peptide
WINPHNGDTTFAERFQG

SEQ ID NO: 3907 - protein, 30 aa, Artificial Sequence
  Description of Artificial Sequence: Synthetic polypeptide
RVALTRDTSINTAYMELSRLTSDDTAVYFC

SEQ ID NO: 3908 - protein, 20 aa, Artificial Sequence
  Description of Artificial Sequence: Synthetic peptide
ARDFGVRYDDSRQLMKYCDS

SEQ ID NO: 3909 - protein, 11 aa, Artificial Sequence
  Description of Artificial Sequence: Synthetic peptide
WGQGTLVTVSS

SEQ ID NO: 3910 - DNA, 381 bp, Artificial Sequence
  Description of Artificial Sequence: Synthetic polynucleotide
caggtccagcttgtgcagtctggggctgaggtgaagaagcctggggcctcagtgaaggtctcctgcaaggcctctggatacaccttcagtttgttccatgtacactgggtgcgacaggcccctggccaaggacttgagtggatgggatggatcaacccccacaatggtgacacaacgtttgcagagagatttcagggaagagtcgccctgaccagggacacgtccatcaatacagcctacatggagttgagcaggctgacctctgacgacacggccgtttatttttgtgcgagagattttggggttcgctatgatgatagtcgccaattaatgaaatactgtgactcctggggccagggaaccctggtcaccgtctcttca

SEQ ID NO: 3911 - skipped

SEQ ID NO: 3912 - protein, 111 aa, Artificial Sequence
  Description of Artificial Sequence: Synthetic polypeptide
NFMLTQPHSVSESPGKAVIISCTRSSGNIASNFVQWYQQRPGSSPTPVIYEDKLRPSGVPDRFSGSIDRSSNSASLTISGLKTEDEADYYCQSYDSGNLVVFGGGTKLTVL

SEQ ID NO: 3913 - protein, 22 aa, Artificial Sequence
  Description of Artificial Sequence: Synthetic peptide
NFMLTQPHSVSESPGKAVIISC

SEQ ID NO: 3914 - protein, 13 aa, Artificial Sequence
  Description of Artificial Sequence: Synthetic peptide
TRSSGNIASNFVQ

SEQ ID NO: 3915 - protein, 15 aa, Artificial Sequence
  Description of Artificial Sequence: Synthetic peptide
WYQQRPGSSPTPVIY

SEQ ID NO: 3916 - protein, 7 aa, Artificial Sequence
  Description of Artificial Sequence: Synthetic peptide
EDKLRPS

SEQ ID NO: 3917 - protein, 34 aa, Artificial Sequence
  Description of Artificial Sequence: Synthetic polypeptide
GVPDRFSGSIDRSSNSASLTISGLKTEDEADYYC

SEQ ID NO: 3918 - protein, 10 aa, Artificial Sequence
  Description of Artificial Sequence: Synthetic peptide
QSYDSGNLVV

SEQ ID NO: 3919 - protein, 10 aa, Artificial Sequence
  Description of Artificial Sequence: Synthetic peptide
FGGGTKLTVL

SEQ ID NO: 3920 - DNA, 333 bp, Artificial Sequence
  Description of Artificial Sequence: Synthetic polynucleotide
aattttatgctgactcagccccactctgtgtcggagtctccggggaaggcggtaatcatctcctgcacccgcagcagtggcaacattgccagcaactttgtgcagtggtaccagcagcgcccgggcagttcccccacccctgtgatctatgaagataaacttagaccctctggggtccctgatcggttctctggctccatcgacagatcctccaactctgcctccctcaccatctctggactgaagactgaggacgaggctgactactactgtcagtcatatgacagtggcaatcttgtggttttcggcggggggaccaagctcaccgtccta

SEQ ID NO: 3921-4001 - skipped (81 entries)

SEQ ID NO: 4002 - protein, 126 aa, Artificial Sequence
  Description of Artificial Sequence: Synthetic polypeptide
QVQLVQSGAEVKKPGSSVKVSCKASGGTLADYAISWVRQAPGQGLEWMGGIKPLHGAAGYSQLFRGRLSITADESASTAYMELTGLTSDDTAMYYCARDPSILNTGNHHWYDLDLWGQGTTVTVSS

SEQ ID NO: 4003 - protein, 26 aa, Artificial Sequence
  Description of Artificial Sequence: Synthetic peptide
QVQLVQSGAEVKKPGSSVKVSCKASG

SEQ ID NO: 4004 - protein, 9 aa, Artificial Sequence
  Description of Artificial Sequence: Synthetic peptide
GTLADYAIS

SEQ ID NO: 4005 - protein, 14 aa, Artificial Sequence
  Description of Artificial Sequence: Synthetic peptide
WVRQAPGQGLEWMG

SEQ ID NO: 4006 - protein, 17 aa, Artificial Sequence
  Description of Artificial Sequence: Synthetic peptide
GIKPLHGAAGYSQLFRG

SEQ ID NO: 4007 - protein, 30 aa, Artificial Sequence
  Description of Artificial Sequence: Synthetic polypeptide
RLSITADESASTAYMELTGLTSDDTAMYYC

SEQ ID NO: 4008 - protein, 19 aa, Artificial Sequence
  Description of Artificial Sequence: Synthetic peptide
ARDPSILNTGNHHWYDLDL

SEQ ID NO: 4009 - protein, 11 aa, Artificial Sequence
  Description of Artificial Sequence: Synthetic peptide
WGQGTTVTVSS

SEQ ID NO: 4010 - DNA, 378 bp, Artificial Sequence
  Description of Artificial Sequence: Synthetic polynucleotide
caggtccagcttgtacagtctggggctgaggtgaagaagcctgggtcctcggtgaaggtctcctgcaaggcctctggaggcaccctcgctgactatgcaatcagttgggtgcgacaggcccctggacagggacttgagtggatgggggggatcaaacctctccatggtgcggcaggctactcacagcttttccggggcagactctcgattaccgcggacgaatctgcgagcacggcctacatggagctgaccggcctgacatctgacgacacggccatgtattactgtgcgagagatccgtctattcttaatactgggaatcaccactggtatgatttagatctctggggccaagggaccacggtcaccgtctcctca

SEQ ID NO: 4011 - skipped

SEQ ID NO: 4012 - protein, 112 aa, Artificial Sequence
  Description of Artificial Sequence: Synthetic polypeptide
DIQMTQSPLSLPVTLGQAASISCRSSQPIPHTDGNTYLNWFHQRPGQSPRRLIHKVSNRDSGVPDRFSGSGSGLDFTLEISGVEAEDVGIYYCMQGTEWPRTFGQGTKVEIK

SEQ ID NO: 4013 - protein, 23 aa, Artificial Sequence
  Description of Artificial Sequence: Synthetic peptide
DIQMTQSPLSLPVTLGQAASISC

SEQ ID NO: 4014 - protein, 16 aa, Artificial Sequence
  Description of Artificial Sequence: Synthetic peptide
RSSQPIPHTDGNTYLN

SEQ ID NO: 4015 - protein, 15 aa, Artificial Sequence
  Description of Artificial Sequence: Synthetic peptide
WFHQRPGQSPRRLIH

SEQ ID NO: 4016 - protein, 7 aa, Artificial Sequence
  Description of Artificial Sequence: Synthetic peptide
KVSNRDS

SEQ ID NO: 4017 - protein, 32 aa, Artificial Sequence
  Description of Artificial Sequence: Synthetic polypeptide
GVPDRFSGSGSGLDFTLEISGVEAEDVGIYYC

SEQ ID NO: 4018 - protein, 9 aa, Artificial Sequence
  Description of Artificial Sequence: Synthetic peptide
MQGTEWPRT

SEQ ID NO: 4019 - protein, 10 aa, Artificial Sequence
  Description of Artificial Sequence: Synthetic peptide
FGQGTKVEIK

SEQ ID NO: 4020 - DNA, 336 bp, Artificial Sequence
  Description of Artificial Sequence: Synthetic polynucleotide
gacatccagatgacccagtctccactctccctgcccgtcacccttggacaggcggcctccatctcctgcaggtcgagtcagcccatcccgcacactgatgggaacacctatttgaattggtttcaccagaggccaggccaatctccaaggcgccttattcataaggtttctaaccgggactctggggtcccagacagattcagcggcagtgggtcaggccttgacttcacactggaaatcagcggggtggaggctgaggatgttggcatttattattgcatgcagggtacagagtggcctcggacgttcggccaagggaccaaggtggagatcaaa

SEQ ID NO: 4021-4101 - skipped (81 entries)

SEQ ID NO: 4102 - protein, 124 aa, Artificial Sequence
  Description of Artificial Sequence: Synthetic polypeptide
QVQLVQSGPELKKPGSSVRVSCKASGGSISSYAISWVRQAPGQRLEWMGGVLPMMGRESPVQKFKDRVTIAADESTSTAYMELRSLSAEDTAVYYCVVDTTMADPHNWYGLDVWGQGTTVTVSS

SEQ ID NO: 4103 - protein, 26 aa, Artificial Sequence
  Description of Artificial Sequence: Synthetic peptide
QVQLVQSGPELKKPGSSVRVSCKASG

SEQ ID NO: 4104 - protein, 9 aa, Artificial Sequence
  Description of Artificial Sequence: Synthetic peptide
GSISSYAIS

SEQ ID NO: 4105 - protein, 14 aa, Artificial Sequence
  Description of Artificial Sequence: Synthetic peptide
WVRQAPGQRLEWMG

SEQ ID NO: 4106 - protein, 17 aa, Artificial Sequence
  Description of Artificial Sequence: Synthetic peptide
GVLPMMGRESPVQKFKD

SEQ ID NO: 4107 - protein, 30 aa, Artificial Sequence
  Description of Artificial Sequence: Synthetic polypeptide
RVTIAADESTSTAYMELRSLSAEDTAVYYC

SEQ ID NO: 4108 - protein, 17 aa, Artificial Sequence
  Description of Artificial Sequence: Synthetic peptide
VVDTTMADPHNWYGLDV

SEQ ID NO: 4109 - protein, 11 aa, Artificial Sequence
  Description of Artificial Sequence: Synthetic peptide
WGQGTTVTVSS

SEQ ID NO: 4110 - DNA, 372 bp, Artificial Sequence
  Description of Artificial Sequence: Synthetic polynucleotide
caggtccagcttgtgcagtctgggcctgagttgaagaagcccgggtcctcggtgagagtctcctgcaaggcttctggaggctccatcagcagttatgctatcagctgggtgcgacaggcccctggacaaagacttgagtggatgggaggagtcctgcctatgatgggcagagaaagccctgtacagaagttcaaggacagagtcaccattgccgcggacgagtccacgagcacagcctacatggaattgagaagcctgagtgctgaagacacggccgtctattactgtgtcgtagatacaactatggcagacccgcacaactggtacggtttggacgtctggggccaagggaccacggtcaccgtctcctca

SEQ ID NO: 4111 - skipped

SEQ ID NO: 4112 - protein, 112 aa, Artificial Sequence
  Description of Artificial Sequence: Synthetic polypeptide
EIVMTQTPLSLPVTLGQPASISCRSSHGLVHTNGNTYLNWFHQRPGQPPRRLIYQVSHRDSGVPDRFSGSGSGTDFTLKISRVEADDVGVYYCMQGTDWPRTFGQGTKVDIK

SEQ ID NO: 4113 - protein, 23 aa, Artificial Sequence
  Description of Artificial Sequence: Synthetic peptide
EIVMTQTPLSLPVTLGQPASISC

SEQ ID NO: 4114 - protein, 16 aa, Artificial Sequence
  Description of Artificial Sequence: Synthetic peptide
RSSHGLVHTNGNTYLN

SEQ ID NO: 4115 - protein, 15 aa, Artificial Sequence
  Description of Artificial Sequence: Synthetic peptide
WFHQRPGQPPRRLIY

SEQ ID NO: 4116 - protein, 7 aa, Artificial Sequence
  Description of Artificial Sequence: Synthetic peptide
QVSHRDS

SEQ ID NO: 4117 - protein, 32 aa, Artificial Sequence; identical to SEQ ID NO: 3317
  Description of Artificial Sequence: Synthetic polypeptide

SEQ ID NO: 4118 - protein, 9 aa, Artificial Sequence
  Description of Artificial Sequence: Synthetic peptide
MQGTDWPRT

SEQ ID NO: 4119 - protein, 10 aa, Artificial Sequence
  Description of Artificial Sequence: Synthetic peptide
FGQGTKVDIK

SEQ ID NO: 4120 - DNA, 336 bp, Artificial Sequence
  Description of Artificial Sequence: Synthetic polynucleotide
gaaattgtaatgactcagactccactctccctgcccgtcacccttggacagccggcctccatctcctgcaggtctagtcacggcctcgtgcacactaatggaaacacctacttgaattggtttcaccagaggccaggccagcctccaaggcgcctaatttatcaggtttctcaccgggactctggggtcccagacagattcagcggcagtgggtcaggcactgatttcacactgaaaatcagcagggtggaggctgacgatgttggggtttattactgcatgcagggtacagactggcctcggacgttcggccaagggaccaaagtggatatcaaa

SEQ ID NO: 4121-4201 - skipped (81 entries)

SEQ ID NO: 4202 - protein, 130 aa, Artificial Sequence
  Description of Artificial Sequence: Synthetic polypeptide
QVQLVQSGPGLVRPSGTLSLTCAVSGDSISGDYWCTWVRQTPGKGLEWIGKISHSGSINYNPSLKSRITMSVDKSKNQFSLKLNSVTAADTAMYYCARVRVGASHHNFWSGYYTDAFDIWGQGTTVTVSS

SEQ ID NO: 4203 - protein, 26 aa, Artificial Sequence
  Description of Artificial Sequence: Synthetic peptide
QVQLVQSGPGLVRPSGTLSLTCAVSG

SEQ ID NO: 4204 - protein, 10 aa, Artificial Sequence
  Description of Artificial Sequence: Synthetic peptide
DSISGDYWCT

SEQ ID NO: 4205 - protein, 14 aa, Artificial Sequence
  Description of Artificial Sequence: Synthetic peptide
WVRQTPGKGLEWIG

SEQ ID NO: 4206 - protein, 16 aa, Artificial Sequence
  Description of Artificial Sequence: Synthetic peptide
KISHSGSINYNPSLKS

SEQ ID NO: 4207 - protein, 30 aa, Artificial Sequence
  Description of Artificial Sequence: Synthetic polypeptide
RITMSVDKSKNQFSLKLNSVTAADTAMYYC

SEQ ID NO: 4208 - protein, 23 aa, Artificial Sequence
  Description of Artificial Sequence: Synthetic peptide
ARVRVGASHHNFWSGYYTDAFDI

SEQ ID NO: 4209 - protein, 11 aa, Artificial Sequence
  Description of Artificial Sequence: Synthetic peptide
WGQGTTVTVSS

SEQ ID NO: 4210 - DNA, 390 bp, Artificial Sequence
  Description of Artificial Sequence: Synthetic polynucleotide
caggtccagcttgtacagtctggcccaggactggtgaggccttcggggaccctgtccctcacctgcgctgtctctggtgactccatcagcggtgattactggtgtacttgggtccgccagaccccagggaaggggctggagtggatcgggaaaatctctcatagtgggagtatcaattacaacccgtccctcaagagtcgaatcaccatgtcagtagacaagtctaagaatcagttctccctgaagctgaactctgtgaccgccgcggacacggccatgtattactgtgcgcgagtgagggtcggcgcctctcatcacaatttttggagtggttattataccgatgcttttgatatctggggccaagggaccacggtcaccgtctcctca

SEQ ID NO: 4211 - skipped

SEQ ID NO: 4212 - protein, 109 aa, Artificial Sequence
  Description of Artificial Sequence: Synthetic polypeptide
ETTLTQSPGTLSLSPGERATLSCRASQSVGNNYLAWYQQKPGQAPRLLIYGASSRATGIPDRFSGSGSGTDFTLTISRLEPEDFAVYYCQQYGTSPVYTFGQGTKVEIK

SEQ ID NO: 4213 - protein, 23 aa, Artificial Sequence
  Description of Artificial Sequence: Synthetic peptide
ETTLTQSPGTLSLSPGERATLSC

SEQ ID NO: 4214 - protein, 12 aa, Artificial Sequence
  Description of Artificial Sequence: Synthetic peptide
RASQSVGNNYLA

SEQ ID NO: 4215 - protein, 15 aa, Artificial Sequence
  Description of Artificial Sequence: Synthetic peptide
WYQQKPGQAPRLLIY

SEQ ID NO: 4216 - protein, 7 aa, Artificial Sequence
  Description of Artificial Sequence: Synthetic peptide
GASSRAT

SEQ ID NO: 4217 - protein, 32 aa, Artificial Sequence; identical to SEQ ID NO: 2917
  Description of Artificial Sequence: Synthetic polypeptide

SEQ ID NO: 4218 - protein, 10 aa, Artificial Sequence
  Description of Artificial Sequence: Synthetic peptide
QQYGTSPVYT

SEQ ID NO: 4219 - protein, 10 aa, Artificial Sequence
  Description of Artificial Sequence: Synthetic peptide
FGQGTKVEIK

SEQ ID NO: 4220 - DNA, 327 bp, Artificial Sequence
  Description of Artificial Sequence: Synthetic polynucleotide
gaaacgacactcacgcagtctccaggcaccctgtctttgtccccaggggaaagagccaccctctcctgcagggccagtcagagtgttggaaataactacttagcatggtaccagcaaaaacctggccaggctcccaggctcctcatctatggtgcatccagcagggccactggcatcccagacaggttcagtggaagtgggtctgggacagacttcactctcaccatcagcagactggagcctgaagattttgcagtgtattactgtcagcaatatggtacctcaccggtgtacacctttggccaggggaccaaggtggagatcaaa

SEQ ID NO: 4221-4301 - skipped (81 entries)

SEQ ID NO: 4302 - protein, 126 aa, Artificial Sequence
  Description of Artificial Sequence: Synthetic polypeptide
QVQLVQSGAEVKKPGSSVKVSCKVSGGTFSNYAISWLRQAPGQGPEWMGGIIPALSRVGYARKFQARLTISADELTTTAYMDLSSLTSEDTAVYYCARDPSFLNTGNHFWYDFDMWGQGTTVTVSS

SEQ ID NO: 4303 - protein, 26 aa, Artificial Sequence
  Description of Artificial Sequence: Synthetic peptide
QVQLVQSGAEVKKPGSSVKVSCKVSG

SEQ ID NO: 4304 - protein, 9 aa, Artificial Sequence
  Description of Artificial Sequence: Synthetic peptide
GTFSNYAIS

SEQ ID NO: 4305 - protein, 14 aa, Artificial Sequence
  Description of Artificial Sequence: Synthetic peptide
WLRQAPGQGPEWMG

SEQ ID NO: 4306 - protein, 17 aa, Artificial Sequence
  Description of Artificial Sequence: Synthetic peptide
GIIPALSRVGYARKFQA

SEQ ID NO: 4307 - protein, 30 aa, Artificial Sequence
  Description of Artificial Sequence: Synthetic polypeptide
RLTISADELTTTAYMDLSSLTSEDTAVYYC

SEQ ID NO: 4308 - protein, 19 aa, Artificial Sequence
  Description of Artificial Sequence: Synthetic peptide
ARDPSFLNTGNHFWYDFDM

SEQ ID NO: 4309 - protein, 11 aa, Artificial Sequence
  Description of Artificial Sequence: Synthetic peptide
WGQGTTVTVSS

SEQ ID NO: 4310 - DNA, 378 bp, Artificial Sequence
  Description of Artificial Sequence: Synthetic polynucleotide
caggtccagcttgtacagtctggggctgaagtgaagaagcctgggtcctcggtgaaggtctcctgcaaggtttctggaggcaccttcagtaactacgctatcagttggctgcgacaggcccctggacaagggcctgagtggatgggagggatcatccctgcgttgagtagagtaggctacgctcggaagttccaggccagactcacgattagcgcggacgagttgacgactacagcctacatggacctgagcagcctaacgtctgaggacacggccgtctattactgtgcgagagatccgtcttttcttaatactgggaatcacttctggtatgattttgatatgtggggccaagggaccacggtcactgtctcctca

SEQ ID NO: 4311 - skipped

SEQ ID NO: 4312 - protein, 112 aa, Artificial Sequence
  Description of Artificial Sequence: Synthetic polypeptide
DIQLTQSPLSLPVTLGQPASISCTSSQNVVHTDGNTYLNWFHQRPGQSPRRLIYKVSNRDSGVPDRFSGSGSGSHFTLKISRVEAEDVGIYYCMQGTDWPRTFGQGTKVEIK

SEQ ID NO: 4313 - protein, 23 aa, Artificial Sequence
  Description of Artificial Sequence: Synthetic peptide
DIQLTQSPLSLPVTLGQPASISC

SEQ ID NO: 4314 - protein, 16 aa, Artificial Sequence
  Description of Artificial Sequence: Synthetic peptide
TSSQNVVHTDGNTYLN

SEQ ID NO: 4315 - protein, 15 aa, Artificial Sequence
  Description of Artificial Sequence: Synthetic peptide
WFHQRPGQSPRRLIY

SEQ ID NO: 4316 - protein, 7 aa, Artificial Sequence
  Description of Artificial Sequence: Synthetic peptide
KVSNRDS

SEQ ID NO: 4317 - protein, 32 aa, Artificial Sequence
  Description of Artificial Sequence: Synthetic polypeptide
GVPDRFSGSGSGSHFTLKISRVEAEDVGIYYC

SEQ ID NO: 4318 - protein, 9 aa, Artificial Sequence
  Description of Artificial Sequence: Synthetic peptide
MQGTDWPRT

SEQ ID NO: 4319 - protein, 10 aa, Artificial Sequence
  Description of Artificial Sequence: Synthetic peptide
FGQGTKVEIK

SEQ ID NO: 4320 - DNA, 336 bp, Artificial Sequence
  Description of Artificial Sequence: Synthetic polynucleotide
gacatccagttgacccagtctccactctccctgcccgtcacccttggacagccggcctccatctcctgcacgtctagtcaaaacgtcgtacacactgatggaaacacctacttgaattggtttcaccagaggccaggccaatctccaaggcgcctcatttataaggtttctaaccgggactctggggtcccagacaggttcagcggcagtgggtcaggctctcatttcacactgaaaatcagcagggtggaggctgaggatgttgggatttattactgcatgcaaggtacagactggcctcggacgttcggccaagggaccaaggtggaaatcaaa

SEQ ID NO: 4321-4401 - skipped (81 entries)

SEQ ID NO: 4402 - protein, 122 aa, Artificial Sequence
  Description of Artificial Sequence: Synthetic polypeptide
EVQLQQSGAEVKKPGSSVKVSCKASGGTSSTHAISWVRQAPGQGLEWMGGIIPIFGTTNYAQKFQDRVTITADESTSTAYMELSSLRSEDTAVYFCVRDGAYDSSGYYSTQWGQGTLVTVSS

SEQ ID NO: 4403 - protein, 26 aa, Artificial Sequence
  Description of Artificial Sequence: Synthetic peptide
EVQLQQSGAEVKKPGSSVKVSCKASG

SEQ ID NO: 4404 - protein, 9 aa, Artificial Sequence
  Description of Artificial Sequence: Synthetic peptide
GTSSTHAIS

SEQ ID NO: 4405 - protein, 14 aa, Artificial Sequence
  Description of Artificial Sequence: Synthetic peptide
WVRQAPGQGLEWMG

SEQ ID NO: 4406 - protein, 17 aa, Artificial Sequence
  Description of Artificial Sequence: Synthetic peptide
GIIPIFGTTNYAQKFQD

SEQ ID NO: 4407 - protein, 30 aa, Artificial Sequence; identical to SEQ ID NO: 3607
  Description of Artificial Sequence: Synthetic polypeptide

SEQ ID NO: 4408 - protein, 15 aa, Artificial Sequence
  Description of Artificial Sequence: Synthetic peptide
VRDGAYDSSGYYSTQ

SEQ ID NO: 4409 - protein, 11 aa, Artificial Sequence
  Description of Artificial Sequence: Synthetic peptide
WGQGTLVTVSS

SEQ ID NO: 4410 - DNA, 366 bp, Artificial Sequence
  Description of Artificial Sequence: Synthetic polynucleotide
gaggtacagctgcagcagtctggggctgaggtgaagaagcctgggtcctcggtgaaggtctcctgcaaggcttctggaggcacctccagcacccatgctatcagctgggtgcgacaggcccctggacaagggcttgagtggatgggagggatcatccctatctttggtacaacaaactacgcacagaagttccaggacagagtcacgattaccgcggacgaatccacgagcacagcctacatggaactgagtagcctgagatctgaagacacggccgtatatttctgtgtgagagatggtgcctatgatagcagtggttattattccacccaatggggccagggaaccctggtcaccgtctcctca

SEQ ID NO: 4411 - skipped

SEQ ID NO: 4412 - protein, 109 aa, Artificial Sequence
  Description of Artificial Sequence: Synthetic polypeptide
DIVLTQTPATLSLSPGERATLSCRASQSVSNFLAWYQQKPGQPPRLLIYDASNRASGIAARFSGRGSGTDFTLTISSLEPEDFAVYYCQQRRNWPPMYTFGQGTKVEIK

SEQ ID NO: 4413 - protein, 23 aa, Artificial Sequence
  Description of Artificial Sequence: Synthetic peptide
DIVLTQTPATLSLSPGERATLSC

SEQ ID NO: 4414 - protein, 11 aa, Artificial Sequence
  Description of Artificial Sequence: Synthetic peptide
RASQSVSNFLA

SEQ ID NO: 4415 - protein, 15 aa, Artificial Sequence
  Description of Artificial Sequence: Synthetic peptide
WYQQKPGQPPRLLIY

SEQ ID NO: 4416 - protein, 7 aa, Artificial Sequence
  Description of Artificial Sequence: Synthetic peptide
DASNRAS

SEQ ID NO: 4417 - protein, 32 aa, Artificial Sequence; identical to SEQ ID NO: 3617
  Description of Artificial Sequence: Synthetic polypeptide

SEQ ID NO: 4418 - protein, 11 aa, Artificial Sequence
  Description of Artificial Sequence: Synthetic peptide
QQRRNWPPMYT

SEQ ID NO: 4419 - protein, 10 aa, Artificial Sequence
  Description of Artificial Sequence: Synthetic peptide
FGQGTKVEIK

SEQ ID NO: 4420 - DNA, 327 bp, Artificial Sequence
  Description of Artificial Sequence: Synthetic polynucleotide
gatattgtgctgacgcagactccagccaccctgtctttgtctccaggggaaagagccaccctctcctgcagggccagtcagagcgttagcaacttcttagcctggtaccaacaaaaacctggccagcctcccaggctcctcatctatgatgcatccaacagggcctctggcatcgcagccaggttcagtggccgtgggtctgggacagacttcactctcaccatcagcagcctagagcctgaagattttgcagtttattactgtcagcagcgtcgcaactggcctccgatgtacacttttggccaggggaccaaggtggaaatcaaa

SEQ ID NO: 4421-4501 - skipped (81 entries)

SEQ ID NO: 4502 - protein, 128 aa, Artificial Sequence
  Description of Artificial Sequence: Synthetic polypeptide
QVQLVESGGDLVKPGRSLRLSCTASGFTIGDYAMTWFRQAPGKGLECVAVIRSRAFGGTTEYAASVKGRFIVSRDDSNSVAFLQMNSLKTEDTAVYYCSRDLRRGYYDSNGHQQFDLWGQGTLVTVSS

SEQ ID NO: 4503 - protein, 26 aa, Artificial Sequence
  Description of Artificial Sequence: Synthetic peptide
QVQLVESGGDLVKPGRSLRLSCTASG

SEQ ID NO: 4504 - protein, 9 aa, Artificial Sequence
  Description of Artificial Sequence: Synthetic peptide
FTIGDYAMT

SEQ ID NO: 4505 - protein, 14 aa, Artificial Sequence
  Description of Artificial Sequence: Synthetic peptide
WFRQAPGKGLECVA

SEQ ID NO: 4506 - protein, 19 aa, Artificial Sequence
  Description of Artificial Sequence: Synthetic peptide
VIRSRAFGGTTEYAASVKG

SEQ ID NO: 4507 - protein, 30 aa, Artificial Sequence
  Description of Artificial Sequence: Synthetic polypeptide
RFIVSRDDSNSVAFLQMNSLKTEDTAVYYC

SEQ ID NO: 4508 - protein, 19 aa, Artificial Sequence
  Description of Artificial Sequence: Synthetic peptide
SRDLRRGYYDSNGHQQFDL

SEQ ID NO: 4509 - protein, 11 aa, Artificial Sequence
  Description of Artificial Sequence: Synthetic peptide
WGQGTLVTVSS

SEQ ID NO: 4510 - DNA, 384 bp, Artificial Sequence
  Description of Artificial Sequence: Synthetic polynucleotide
caggtgcagctggtggagtctgggggagacttggtaaagccagggcggtccctgagactctcctgtacagcttctggattcaccattggtgattatgccatgacctggttccgccaggctccagggaaggggctggagtgcgtagctgtcattaggagcagagcttttggtgggacaacagaatatgccgcgtctgtgaaaggcagattcatcgtctcaagagatgattccaatagcgtcgcctttctgcaaatgaacagcctgaaaaccgaggacacagccgtgtattactgtagtagagatctcagaaggggatactatgatagtaatggtcatcagcaatttgacctctggggccagggaaccctggtcaccgtctcttca

SEQ ID NO: 4511 - skipped

SEQ ID NO: 4512 - protein, 107 aa, Artificial Sequence
  Description of Artificial Sequence: Synthetic polypeptide
DIRLTQSPATLSLSPGERATLSCRASQSIGYYLAWFQQKPGQAPRLLIYDASKRATGIPARFSGSGSGTDFTLTISSLEPEDFAVYYCQHRTNWPYTFGQGTKVEIK

SEQ ID NO: 4513 - protein, 23 aa, Artificial Sequence
  Description of Artificial Sequence: Synthetic peptide
DIRLTQSPATLSLSPGERATLSC

SEQ ID NO: 4514 - protein, 11 aa, Artificial Sequence
  Description of Artificial Sequence: Synthetic peptide
RASQSIGYYLA

SEQ ID NO: 4515 - protein, 15 aa, Artificial Sequence
  Description of Artificial Sequence: Synthetic peptide
WFQQKPGQAPRLLIY

SEQ ID NO: 4516 - protein, 7 aa, Artificial Sequence
  Description of Artificial Sequence: Synthetic peptide
DASKRAT

SEQ ID NO: 4517 - protein, 32 aa, Artificial Sequence
  Description of Artificial Sequence: Synthetic polypeptide
GIPARFSGSGSGTDFTLTISSLEPEDFAVYYC

SEQ ID NO: 4518 - protein, 9 aa, Artificial Sequence
  Description of Artificial Sequence: Synthetic peptide
QHRTNWPYT

SEQ ID NO: 4519 - protein, 10 aa, Artificial Sequence
  Description of Artificial Sequence: Synthetic peptide
FGQGTKVEIK

SEQ ID NO: 4520 - DNA, 321 bp, Artificial Sequence
  Description of Artificial Sequence: Synthetic polynucleotide
gacatccggttgacccagtctccagccaccctgtctttgtctccaggggaaagagccaccctctcctgcagggccagtcagagtattggctactacttagcctggttccaacagaaacctggccaggctcccaggctcctcatctatgatgcgtccaaaagggccaccggcatcccagccaggttcagtggcagtgggtctggaacagacttcactctcaccatcagcagcctagagcctgaagattttgcagtttattactgtcagcaccgtaccaactggccgtacacttttggccaggggaccaaggtggaaatcaaa

SEQ ID NO: 4521-4601 - skipped (81 entries)

SEQ ID NO: 4602 - protein, 136 aa, Artificial Sequence
  Description of Artificial Sequence: Synthetic polypeptide
QVQLVESGGGVVQPGRSLRLSCAASGFTFSRYGMHWVRQAPGKGLEWVAVIYSDGRNEYYADSVKGRFTISRDNSKNTLHLQMNSLGAADTAVYYCARDPGPITFFDWSPDKSRKSYYDYNGMDVWGQGTTVTVSS

SEQ ID NO: 4603 - protein, 26 aa, Artificial Sequence
  Description of Artificial Sequence: Synthetic peptide
QVQLVESGGGVVQPGRSLRLSCAASG

SEQ ID NO: 4604 - protein, 9 aa, Artificial Sequence
  Description of Artificial Sequence: Synthetic peptide
FTFSRYGMH

SEQ ID NO: 4605 - protein, 14 aa, Artificial Sequence
  Description of Artificial Sequence: Synthetic peptide
WVRQAPGKGLEWVA

SEQ ID NO: 4606 - protein, 17 aa, Artificial Sequence
  Description of Artificial Sequence: Synthetic peptide
VIYSDGRNEYYADSVKG

SEQ ID NO: 4607 - protein, 30 aa, Artificial Sequence
  Description of Artificial Sequence: Synthetic polypeptide
RFTISRDNSKNTLHLQMNSLGAADTAVYYC

SEQ ID NO: 4608 - protein, 29 aa, Artificial Sequence
  Description of Artificial Sequence: Synthetic peptide
ARDPGPITFFDWSPDKSRKSYYDYNGMDV

SEQ ID NO: 4609 - protein, 11 aa, Artificial Sequence
  Description of Artificial Sequence: Synthetic peptide
WGQGTTVTVSS

SEQ ID NO: 4610 - DNA, 408 bp, Artificial Sequence
  Description of Artificial Sequence: Synthetic polynucleotide
caggtgcagctggtggaatctgggggaggcgtggtccagcctgggagatccttgagactctcctgtgcagcgtctggattcaccttcagtcgctacggcatgcactgggtccgccaggctccaggcaagggactggagtgggtggcagtcatatattctgatggaagaaatgaatactatgcagactccgtgaagggccgattcaccatctccagagacaattccaagaacacgctacatctgcaaatgaacagcctgggggccgccgacacggctgtttattactgtgcgagagaccctgggccgataacattttttgactggtcaccagataaaagtcgcaaatcttactacgactacaacggaatggacgtctggggccaagggaccacggtcaccgtctcctca

SEQ ID NO: 4611 - skipped

SEQ ID NO: 4612 - protein, 110 aa, Artificial Sequence
  Description of Artificial Sequence: Synthetic polypeptide
QPGLTQEPSLTVSPGGTVTLTCGSSAGAVTSGHYPYWFQQKPGQAPRTLIYDTNNKYSWTPARFSGSLLGGKAALTLSGAQPEDEAEYFCFLSYRGAPPVFGGGTHLTVL

SEQ ID NO: 4613 - protein, 22 aa, Artificial Sequence
  Description of Artificial Sequence: Synthetic peptide
QPGLTQEPSLTVSPGGTVTLTC

SEQ ID NO: 4614 - protein, 14 aa, Artificial Sequence
  Description of Artificial Sequence: Synthetic peptide
GSSAGAVTSGHYPY

SEQ ID NO: 4615 - protein, 15 aa, Artificial Sequence
  Description of Artificial Sequence: Synthetic peptide
WFQQKPGQAPRTLIY

SEQ ID NO: 4616 - protein, 7 aa, Artificial Sequence
  Description of Artificial Sequence: Synthetic peptide
DTNNKYS

SEQ ID NO: 4617 - protein, 32 aa, Artificial Sequence
  Description of Artificial Sequence: Synthetic polypeptide
WTPARFSGSLLGGKAALTLSGAQPEDEAEYFC

SEQ ID NO: 4618 - protein, 10 aa, Artificial Sequence
  Description of Artificial Sequence: Synthetic peptide
FLSYRGAPPV

SEQ ID NO: 4619 - protein, 10 aa, Artificial Sequence
  Description of Artificial Sequence: Synthetic peptide
FGGGTHLTVL

SEQ ID NO: 4620 - DNA, 330 bp, Artificial Sequence
  Description of Artificial Sequence: Synthetic polynucleotide
cagccagggctgactcaggagccctcactgactgtgtccccaggagggacagtcactctcacctgtggctccagcgctggagctgtcaccagtggccattatccctactggttccagcagaagcctggccaagcccccaggacattaatttatgatacaaacaacaaatactcttggacccccgcccgcttctcaggctccctccttgggggcaaagctgccctgactctttcgggtgcgcagcctgaggatgaggctgagtatttctgcttcctctcttatagaggtgcccctcctgtgttcggaggaggcacccacctgaccgtcctc

SEQ ID NO: 4621-4701 - skipped (81 entries)

SEQ ID NO: 4702 - protein, 116 aa, Artificial Sequence
  Description of Artificial Sequence: Synthetic polypeptide
EVQLLESGGGVVQPGTSLRLSCVASGFTFSTFAMHWVRQAPGKGLEWVALISFDSTNIRYANSVRGRFTISRDNSKNTLYLEVDSLRIEDTGVYYCARDLPPLDYWGQGTLVTVSS

SEQ ID NO: 4703 - protein, 26 aa, Artificial Sequence
  Description of Artificial Sequence: Synthetic peptide
EVQLLESGGGVVQPGTSLRLSCVASG

SEQ ID NO: 4704 - protein, 9 aa, Artificial Sequence
  Description of Artificial Sequence: Synthetic peptide
FTFSTFAMH

SEQ ID NO: 4705 - protein, 14 aa, Artificial Sequence
  Description of Artificial Sequence: Synthetic peptide
WVRQAPGKGLEWVA

SEQ ID NO: 4706 - protein, 17 aa, Artificial Sequence
  Description of Artificial Sequence: Synthetic peptide
LISFDSTNIRYANSVRG

SEQ ID NO: 4707 - protein, 30 aa, Artificial Sequence
  Description of Artificial Sequence: Synthetic polypeptide
RFTISRDNSKNTLYLEVDSLRIEDTGVYYC

SEQ ID NO: 4708 - protein, 9 aa, Artificial Sequence
  Description of Artificial Sequence: Synthetic peptide
ARDLPPLDY

SEQ ID NO: 4709 - protein, 11 aa, Artificial Sequence
  Description of Artificial Sequence: Synthetic peptide
WGQGTLVTVSS

SEQ ID NO: 4710 - DNA, 348 bp, Artificial Sequence
  Description of Artificial Sequence: Synthetic polynucleotide
gaggtgcagctgttggagtctgggggaggcgtggtccagcctgggacgtccctgagactctcctgtgtagcctctggattcactttcagcacctttgctatgcactgggtccgccaggctccaggcaaggggctggaatgggtggccctcatttcttttgattcaacaaatataagatatgcaaattccgtgaggggccgattcaccatctccagggacaattccaagaacacactgtatctagaagtggacagcctgagaattgaggacacgggtgtctattactgtgcgagagacctccctccccttgactactggggccagggaaccctggtcaccgtctcctca

SEQ ID NO: 4711 - skipped

SEQ ID NO: 4712 - protein, 107 aa, Artificial Sequence
  Description of Artificial Sequence: Synthetic polypeptide
DIRMTQSPFSLSASVGDRVTITCRASQGFGNRLAWYQQKPGRAPKLLIYDASTLQSGVPSRFSGSGSETDFALTISSLQPEDVATYYCQKHDRDPWTFGQGTKVEIK

SEQ ID NO: 4713 - protein, 23 aa, Artificial Sequence
  Description of Artificial Sequence: Synthetic peptide
DIRMTQSPFSLSASVGDRVTITC

SEQ ID NO: 4714 - protein, 11 aa, Artificial Sequence
  Description of Artificial Sequence: Synthetic peptide
RASQGFGNRLA

SEQ ID NO: 4715 - protein, 15 aa, Artificial Sequence
  Description of Artificial Sequence: Synthetic peptide
WYQQKPGRAPKLLIY

SEQ ID NO: 4716 - protein, 7 aa, Artificial Sequence
  Description of Artificial Sequence: Synthetic peptide
DASTLQS

SEQ ID NO: 4717 - protein, 32 aa, Artificial Sequence
  Description of Artificial Sequence: Synthetic polypeptide
GVPSRFSGSGSETDFALTISSLQPEDVATYYC

SEQ ID NO: 4718 - protein, 9 aa, Artificial Sequence
  Description of Artificial Sequence: Synthetic peptide
QKHDRDPWT

SEQ ID NO: 4719 - protein, 10 aa, Artificial Sequence
  Description of Artificial Sequence: Synthetic peptide
FGQGTKVEIK

SEQ ID NO: 4720 - DNA, 321 bp, Artificial Sequence
  Description of Artificial Sequence: Synthetic polynucleotide
gacatccggatgacccagtctccgttctccctgtctgcatctgtaggagacagagtcaccatcacttgccgggcgagtcagggctttgggaatcgtttagcctggtatcagcagaagccagggagagctcctaaactcctgatatatgatgcatccactttacaatcaggggtcccatctcgattcagcggcagtgggtctgagacagatttcgccctcaccatcagcagcctgcagcctgaggacgttgcaacttattactgtcaaaagcatgaccgtgacccgtggacgttcggccaagggaccaaggtggaaatcaaa

SEQ ID NO: 4721-4801 - skipped (81 entries)

SEQ ID NO: 4802 - protein, 129 aa, Artificial Sequence
  Description of Artificial Sequence: Synthetic polypeptide
QVQLVQSGAEVRKPGSSVKLSCKASGGTFSTHAISWVRQAPGQRPEWMGGIIPIFGESKDTQKFQGRVTFTADESTTTAYMELRSLRSDDTAIYYCVRDSDPYTTTFSHNHYWYAMDVWGQGTTVTVSS

SEQ ID NO: 4803 - protein, 26 aa, Artificial Sequence
  Description of Artificial Sequence: Synthetic peptide
QVQLVQSGAEVRKPGSSVKLSCKASG

SEQ ID NO: 4804 - protein, 9 aa, Artificial Sequence
  Description of Artificial Sequence: Synthetic peptide
GTFSTHAIS

SEQ ID NO: 4805 - protein, 14 aa, Artificial Sequence
  Description of Artificial Sequence: Synthetic peptide
WVRQAPGQRPEWMG

SEQ ID NO: 4806 - protein, 17 aa, Artificial Sequence
  Description of Artificial Sequence: Synthetic peptide
GIIPIFGESKDTQKFQG

SEQ ID NO: 4807 - protein, 30 aa, Artificial Sequence; identical to SEQ ID NO: 1307
  Description of Artificial Sequence: Synthetic polypeptide

SEQ ID NO: 4808 - protein, 22 aa, Artificial Sequence
  Description of Artificial Sequence: Synthetic peptide
VRDSDPYTTTFSHNHYWYAMDV

SEQ ID NO: 4809 - protein, 11 aa, Artificial Sequence
  Description of Artificial Sequence: Synthetic peptide
WGQGTTVTVSS

SEQ ID NO: 4810 - DNA, 387 bp, Artificial Sequence
  Description of Artificial Sequence: Synthetic polynucleotide
caggtccagcttgtgcagtctggggctgaggtgaggaagcctgggtcctcggtgaagctctcctgcaaggcttctggaggcaccttcagcactcatgctatcagttgggtgcggcaggcccctggacaacggcctgagtggatgggagggatcattcctatttttggtgagtcaaaagacacacagaagtttcaaggcagagtcacctttaccgcggacgaatccacgactacagcctacatggagttgaggagcctaagatctgacgacacggccatatattattgtgtgagagactcagacccctacacgacgacttttagccataatcactattggtatgctatggacgtctggggccaggggaccacggtcaccgtctcctca

SEQ ID NO: 4811 - skipped

SEQ ID NO: 4812 - protein, 112 aa, Artificial Sequence
  Description of Artificial Sequence: Synthetic polypeptide
DIVMTQSPLSLPVTLGQPASISCRSSQRLVHSDGNTYLNWFQQRPGQSPRRLIYKVSNRDSGVPDRFSGSGSGTDFTLKISRVEAEDIGVYYCMQGTEWPRTFGQGTKVEIK

SEQ ID NO: 4813 - protein, 23 aa, Artificial Sequence
  Description of Artificial Sequence: Synthetic peptide
DIVMTQSPLSLPVTLGQPASISC

SEQ ID NO: 4814 - protein, 16 aa, Artificial Sequence
  Description of Artificial Sequence: Synthetic peptide
RSSQRLVHSDGNTYLN

SEQ ID NO: 4815 - protein, 15 aa, Artificial Sequence
  Description of Artificial Sequence: Synthetic peptide
WFQQRPGQSPRRLIY

SEQ ID NO: 4816 - protein, 7 aa, Artificial Sequence
  Description of Artificial Sequence: Synthetic peptide
KVSNRDS

SEQ ID NO: 4817 - protein, 32 aa, Artificial Sequence; identical to SEQ ID NO: 1317
  Description of Artificial Sequence: Synthetic polypeptide

SEQ ID NO: 4818 - protein, 9 aa, Artificial Sequence
  Description of Artificial Sequence: Synthetic peptide
MQGTEWPRT

SEQ ID NO: 4819 - protein, 10 aa, Artificial Sequence
  Description of Artificial Sequence: Synthetic peptide
FGQGTKVEIK

SEQ ID NO: 4820 - DNA, 336 bp, Artificial Sequence
  Description of Artificial Sequence: Synthetic polynucleotide
gatattgtgatgacccagtctccactctccctgcccgtcacccttggacagccggcctccatctcctgcaggtctagtcaacgcctcgtacacagtgatggaaacacctacttgaattggtttcagcagaggccaggccaatctccaaggcgcctcatttataaggtttctaaccgggactctggggtcccagacagattcagcggcagtgggtcaggcactgacttcacactgaaaatcagcagggtggaggctgaggacattggagtttattactgcatgcaaggtacagagtggcctcggacttttggccaggggaccaaggtggaaatcaaa

SEQ ID NO: 4821-4901 - skipped (81 entries)

SEQ ID NO: 4902 - protein, 125 aa, Artificial Sequence
  Description of Artificial Sequence: Synthetic polypeptide
QVQLVQSGGGLVQPGGSLRVSCSASGFTFSSFAMHWVRQAPGKGLEYVAGISDNGHTTMYADSVKGRFTISRDNSKNTLYLQLSSLRPEDTAVYFCVKDNVILPGAIVRPQFDYWGQGTLVTVSS

SEQ ID NO: 4903 - protein, 26 aa, Artificial Sequence
  Description of Artificial Sequence: Synthetic peptide
QVQLVQSGGGLVQPGGSLRVSCSASG

SEQ ID NO: 4904 - protein, 9 aa, Artificial Sequence
  Description of Artificial Sequence: Synthetic peptide
FTFSSFAMH

SEQ ID NO: 4905 - protein, 14 aa, Artificial Sequence
  Description of Artificial Sequence: Synthetic peptide
WVRQAPGKGLEYVA

SEQ ID NO: 4906 - protein, 17 aa, Artificial Sequence
  Description of Artificial Sequence: Synthetic peptide
GISDNGHTTMYADSVKG

SEQ ID NO: 4907 - protein, 30 aa, Artificial Sequence
  Description of Artificial Sequence: Synthetic polypeptide
RFTISRDNSKNTLYLQLSSLRPEDTAVYFC

SEQ ID NO: 4908 - protein, 18 aa, Artificial Sequence
  Description of Artificial Sequence: Synthetic peptide
VKDNVILPGAIVRPQFDY

SEQ ID NO: 4909 - protein, 11 aa, Artificial Sequence
  Description of Artificial Sequence: Synthetic peptide
WGQGTLVTVSS

SEQ ID NO: 4910 - DNA, 375 bp, Artificial Sequence
  Description of Artificial Sequence: Synthetic polynucleotide
caggtccagctggtgcagtctgggggaggcttggtccagccgggggggtccctgagagtctcctgctcagcctctggattcaccttcagtagttttgctatgcactgggtccgccaggctccagggaagggactggaatatgttgcaggaatcagtgataatggtcataccacaatgtatgcagactccgtgaagggcagattcaccatctccagagacaattccaagaacacactctatcttcaattgagtagtctgagacctgaggacacggctgtgtatttctgtgtgaaagataacgtgatactacctggtgctattgtccgcccgcaatttgactactggggccagggaaccctggtcaccgtctcctca

SEQ ID NO: 4911 - skipped

SEQ ID NO: 4912 - protein, 107 aa, Artificial Sequence
  Description of Artificial Sequence: Synthetic polypeptide
ETTLTQSPASVSASVGDRVTISCRASQGIGRWLAWYQQKPGRAPKLLIFSASSLQSGVPSRFSGSGSGTDFTLTISSLQPEDFATYYCQQAESFPFTFGGGTKVEIK

SEQ ID NO: 4913 - protein, 23 aa, Artificial Sequence
  Description of Artificial Sequence: Synthetic peptide
ETTLTQSPASVSASVGDRVTISC

SEQ ID NO: 4914 - protein, 11 aa, Artificial Sequence
  Description of Artificial Sequence: Synthetic peptide
RASQGIGRWLA

SEQ ID NO: 4915 - protein, 15 aa, Artificial Sequence
  Description of Artificial Sequence: Synthetic peptide
WYQQKPGRAPKLLIF

SEQ ID NO: 4916 - protein, 7 aa, Artificial Sequence
  Description of Artificial Sequence: Synthetic peptide
SASSLQS

SEQ ID NO: 4917 - protein, 32 aa, Artificial Sequence; identical to SEQ ID NO: 517
  Description of Artificial Sequence: Synthetic polypeptide

SEQ ID NO: 4918 - protein, 9 aa, Artificial Sequence
  Description of Artificial Sequence: Synthetic peptide
QQAESFPFT

SEQ ID NO: 4919 - protein, 10 aa, Artificial Sequence
  Description of Artificial Sequence: Synthetic peptide
FGGGTKVEIK

SEQ ID NO: 4920 - DNA, 321 bp, Artificial Sequence
  Description of Artificial Sequence: Synthetic polynucleotide
gaaacgacactcacgcagtctcctgcttctgtgtctgcctctgtcggagacagagtcaccatctcttgtcgggcgagtcagggaattggtaggtggttagcctggtatcagcagaagccagggagagcccctaaactcctgatcttttctgcatccagtttgcaaagtggagtcccatcaaggttcagcggcagtggatctgggacagatttcactctcactatcagcagcctgcagcctgaggatttcgcaacttactactgtcaacaggctgagagtttcccgttcactttcggcggagggaccaaggtggaaatcaaa

SEQ ID NO: 4921-5001 - skipped (81 entries)

SEQ ID NO: 5002 - protein, 125 aa, Artificial Sequence
  Description of Artificial Sequence: Synthetic polypeptide
EVQLVETGGGVVQPGRSLRLSCVASGFTLAPYGMQWVRQAPGKGLEWVAFLSHDGSHLGYVDSVKGRFTISRDNSKNTLYLEMNSLRAEDTATYYCARDNVVQQNADNVGYFDFWGQGSPVTVSS

SEQ ID NO: 5003 - protein, 26 aa, Artificial Sequence
  Description of Artificial Sequence: Synthetic peptide
EVQLVETGGGVVQPGRSLRLSCVASG

SEQ ID NO: 5004 - protein, 9 aa, Artificial Sequence
  Description of Artificial Sequence: Synthetic peptide
FTLAPYGMQ

SEQ ID NO: 5005 - protein, 14 aa, Artificial Sequence
  Description of Artificial Sequence: Synthetic peptide
WVRQAPGKGLEWVA

SEQ ID NO: 5006 - protein, 17 aa, Artificial Sequence
  Description of Artificial Sequence: Synthetic peptide
FLSHDGSHLGYVDSVKG

SEQ ID NO: 5007 - protein, 30 aa, Artificial Sequence
  Description of Artificial Sequence: Synthetic polypeptide
RFTISRDNSKNTLYLEMNSLRAEDTATYYC

SEQ ID NO: 5008 - protein, 18 aa, Artificial Sequence
  Description of Artificial Sequence: Synthetic peptide
ARDNVVQQNADNVGYFDF

SEQ ID NO: 5009 - protein, 11 aa, Artificial Sequence
  Description of Artificial Sequence: Synthetic peptide
WGQGSPVTVSS

SEQ ID NO: 5010 - DNA, 375 bp, Artificial Sequence
  Description of Artificial Sequence: Synthetic polynucleotide
gaggtgcagctggtggagactgggggaggcgtggtccagcctgggaggtccctgagactctcctgtgtagcctctggattcacgttagctccgtatggtatgcagtgggtccgccaggctccaggcaaggggctggagtgggtggcatttttgtcacatgatggaagtcatcttggttacgtagattccgtgaagggccgattcaccatctccagagacaattccaagaacacactgtatctagagatgaacagcctgagagctgaagacacggctacatattactgtgcgagagataatgtagtgcagcagaatgcagataatgtaggatactttgatttctggggccagggatccccggtcaccgtctcctca

SEQ ID NO: 5011 - skipped

SEQ ID NO: 5012 - protein, 106 aa, Artificial Sequence
  Description of Artificial Sequence: Synthetic polypeptide
DIRLTQSPATLSLSPGERATLSRTASQSVTSYLAWYQQRPGQAPRLLIYDTSNRVTGVPVRFSGSGYGTDFTLTISSLEPEDFAVYYCQQRGNGYTFGPGTKVDIK

SEQ ID NO: 5013 - protein, 23 aa, Artificial Sequence
  Description of Artificial Sequence: Synthetic peptide
DIRLTQSPATLSLSPGERATLSR

SEQ ID NO: 5014 - protein, 11 aa, Artificial Sequence
  Description of Artificial Sequence: Synthetic peptide
TASQSVTSYLA

SEQ ID NO: 5015 - protein, 15 aa, Artificial Sequence
  Description of Artificial Sequence: Synthetic peptide
WYQQRPGQAPRLLIY

SEQ ID NO: 5016 - protein, 7 aa, Artificial Sequence
  Description of Artificial Sequence: Synthetic peptide
DTSNRVT

SEQ ID NO: 5017 - protein, 32 aa, Artificial Sequence
  Description of Artificial Sequence: Synthetic polypeptide
GVPVRFSGSGYGTDFTLTISSLEPEDFAVYYC

SEQ ID NO: 5018 - protein, 8 aa, Artificial Sequence
  Description of Artificial Sequence: Synthetic peptide
QQRGNGYT

SEQ ID NO: 5019 - protein, 10 aa, Artificial Sequence
  Description of Artificial Sequence: Synthetic peptide
FGPGTKVDIK

SEQ ID NO: 5020 - DNA, 318 bp, Artificial Sequence
  Description of Artificial Sequence: Synthetic polynucleotide
gacatccggttgacccagtctccagccaccctgtctttgtctccaggggaaagagccaccctctcccgcaccgccagtcagagtgttaccagctacttagcctggtaccaacagagacctggccaggctcccaggctcctcatctatgatacatccaacagggtcactggcgtcccagtcaggttcagtggcagtgggtatgggacagacttcactctcaccatcagcagcctagagcctgaggattttgcggtttattactgtcagcagcgtggcaacgggtacacctttggcccggggaccaaggtggatatcaaa

SEQ ID NO: 5021-5101 - skipped (81 entries)

SEQ ID NO: 5102 - protein, 126 aa, Artificial Sequence
  Description of Artificial Sequence: Synthetic polypeptide
QVQLVQSGAEVKKPGSSVKVSCKVSGGMFSDYAISWVRQAPGQRLEWMGGIMPGLGSPAYAQIFRGRVTISADISTSTAYLEVTSLRPEDTAVYYCARDPSILNTGNHHWYDLDMWGQGTTVTVSS

SEQ ID NO: 5103 - protein, 26 aa, Artificial Sequence
  Description of Artificial Sequence: Synthetic peptide
QVQLVQSGAEVKKPGSSVKVSCKVSG

SEQ ID NO: 5104 - protein, 9 aa, Artificial Sequence
  Description of Artificial Sequence: Synthetic peptide
GMFSDYAIS

SEQ ID NO: 5105 - protein, 14 aa, Artificial Sequence
  Description of Artificial Sequence: Synthetic peptide
WVRQAPGQRLEWMG

SEQ ID NO: 5106 - protein, 17 aa, Artificial Sequence
  Description of Artificial Sequence: Synthetic peptide
GIMPGLGSPAYAQIFRG

SEQ ID NO: 5107 - protein, 30 aa, Artificial Sequence
  Description of Artificial Sequence: Synthetic polypeptide
RVTISADISTSTAYLEVTSLRPEDTAVYYC

SEQ ID NO: 5108 - protein, 19 aa, Artificial Sequence
  Description of Artificial Sequence: Synthetic peptide
ARDPSILNTGNHHWYDLDM

SEQ ID NO: 5109 - protein, 11 aa, Artificial Sequence
  Description of Artificial Sequence: Synthetic peptide
WGQGTTVTVSS

SEQ ID NO: 5110 - DNA, 378 bp, Artificial Sequence
  Description of Artificial Sequence: Synthetic polynucleotide
caggtccagctggtacagtctggggctgaggtgaagaagcctgggtcctcggtgaaggtctcctgcaaggtttctggaggcatgttcagtgactatgccatcagttgggtgcgacaggcccctggacaacgacttgagtggatgggagggatcatgcctggccttggttcgccagcctacgcacagatttttcggggcagagtcaccatttccgcggacatatccacgagcacggcctacctggaagtgaccagcctgaggcctgaggacacggccgtgtattactgtgcgagagacccgtctattcttaacactgggaatcaccactggtatgatttagatatgtggggccaagggaccacggtcaccgtctcctca

SEQ ID NO: 5111 - skipped

SEQ ID NO: 5112 - protein, 112 aa, Artificial Sequence
  Description of Artificial Sequence: Synthetic polypeptide
ETTLTQSPLSLPVDLGQSASISCRSSQRVVHTNGNTYLHWFHQRPGQAPRRLIYKVSNRESGVPDRFSGSGSGTDFTLRISRVEAEDVGVYYCMQATDWPRTFGQGTKVEIK

SEQ ID NO: 5113 - protein, 23 aa, Artificial Sequence
  Description of Artificial Sequence: Synthetic peptide
ETTLTQSPLSLPVDLGQSASISC

SEQ ID NO: 5114 - protein, 16 aa, Artificial Sequence
  Description of Artificial Sequence: Synthetic peptide
RSSQRVVHTNGNTYLH

SEQ ID NO: 5115 - protein, 15 aa, Artificial Sequence
  Description of Artificial Sequence: Synthetic peptide
WFHQRPGQAPRRLIY

SEQ ID NO: 5116 - protein, 7 aa, Artificial Sequence
  Description of Artificial Sequence: Synthetic peptide
KVSNRES

SEQ ID NO: 5117 - protein, 32 aa, Artificial Sequence; identical to SEQ ID NO: 3517
  Description of Artificial Sequence: Synthetic polypeptide

SEQ ID NO: 5118 - protein, 9 aa, Artificial Sequence
  Description of Artificial Sequence: Synthetic peptide
MQATDWPRT

SEQ ID NO: 5119 - protein, 10 aa, Artificial Sequence
  Description of Artificial Sequence: Synthetic peptide
FGQGTKVEIK

SEQ ID NO: 5120 - DNA, 336 bp, Artificial Sequence
  Description of Artificial Sequence: Synthetic polynucleotide
gaaacgacactcacgcagtctccactctccctgcccgtcgacctcggacagtcggcctccatctcctgcaggtctagtcaaagggtcgtgcacactaatgggaacacctacttgcattggtttcaccagaggccaggccaagctccaaggcgcctcatttataaggtttctaaccgggagtccggggtcccagacagattcagcggcagtgggtcaggcactgatttcaccctgagaatcagcagggtggaggctgaggatgttggcgtttattactgcatgcaagctacagactggcctcggacgttcggccaagggaccaaggtggaaatcaaa

SEQ ID NO: 5121-5201 - skipped (81 entries)

SEQ ID NO: 5202 - protein, 125 aa, Artificial Sequence
  Description of Artificial Sequence: Synthetic polypeptide
EVQLVESGGGVVQPGRSLRLSCVASGFTLAPYGMQWVRQAPGKGLEWVAFLSHDGSHLGYVDSVKGRFTISRDNSKNTLYLEMNSLRAEDTATYYCARDNVVQQNADNVGYFDFWGQGSLVTVSS

SEQ ID NO: 5203 - protein, 26 aa, Artificial Sequence
  Description of Artificial Sequence: Synthetic peptide
EVQLVESGGGVVQPGRSLRLSCVASG

SEQ ID NO: 5204 - protein, 9 aa, Artificial Sequence
  Description of Artificial Sequence: Synthetic peptide
FTLAPYGMQ

SEQ ID NO: 5205 - protein, 14 aa, Artificial Sequence
  Description of Artificial Sequence: Synthetic peptide
WVRQAPGKGLEWVA

SEQ ID NO: 5206 - protein, 17 aa, Artificial Sequence
  Description of Artificial Sequence: Synthetic peptide
FLSHDGSHLGYVDSVKG

SEQ ID NO: 5207 - protein, 30 aa, Artificial Sequence; identical to SEQ ID NO: 5007
  Description of Artificial Sequence: Synthetic polypeptide

SEQ ID NO: 5208 - protein, 18 aa, Artificial Sequence
  Description of Artificial Sequence: Synthetic peptide
ARDNVVQQNADNVGYFDF

SEQ ID NO: 5209 - protein, 11 aa, Artificial Sequence
  Description of Artificial Sequence: Synthetic peptide
WGQGSLVTVSS

SEQ ID NO: 5210 - DNA, 375 bp, Artificial Sequence
  Description of Artificial Sequence: Synthetic polynucleotide
gaggtgcagctggtggagtctgggggaggcgtggtccagcctgggaggtccctgagactctcctgtgtagcctctggattcacgttagctccgtatggtatgcagtgggtccgccaggctccaggcaaggggctggagtgggtggcatttttgtcacatgatggaagtcatcttggttacgtagactccgtgaagggccgattcaccatctccagagacaattccaagaacacactgtatctagagatgaacagcctgagagctgaagacacggctacatattactgtgcgagagataatgtagtgcagcagaatgcagataatgtaggatactttgatttctggggccagggatccctggtcaccgtctcctca

SEQ ID NO: 5211 - skipped

SEQ ID NO: 5212 - protein, 106 aa, Artificial Sequence
  Description of Artificial Sequence: Synthetic polypeptide
CIRLTQSPATLSLSPGERATLSCRASQSVTSYLAWYQQRPGQAPRLLIYDTSNRVTGVPVRFSGSGYGTDFTLTISSLEPEDFAVYYCQQRGNGYTFGPGTKVEIK

SEQ ID NO: 5213 - protein, 23 aa, Artificial Sequence
  Description of Artificial Sequence: Synthetic peptide
CIRLTQSPATLSLSPGERATLSC

SEQ ID NO: 5214 - protein, 11 aa, Artificial Sequence
  Description of Artificial Sequence: Synthetic peptide
RASQSVTSYLA

SEQ ID NO: 5215 - protein, 15 aa, Artificial Sequence
  Description of Artificial Sequence: Synthetic peptide
WYQQRPGQAPRLLIY

SEQ ID NO: 5216 - protein, 7 aa, Artificial Sequence
  Description of Artificial Sequence: Synthetic peptide
DTSNRVT

SEQ ID NO: 5217 - protein, 32 aa, Artificial Sequence; identical to SEQ ID NO: 5017
  Description of Artificial Sequence: Synthetic polypeptide

SEQ ID NO: 5218 - protein, 8 aa, Artificial Sequence
  Description of Artificial Sequence: Synthetic peptide
QQRGNGYT

SEQ ID NO: 5219 - protein, 10 aa, Artificial Sequence
  Description of Artificial Sequence: Synthetic peptide
FGPGTKVEIK

SEQ ID NO: 5220 - DNA, 318 bp, Artificial Sequence
  Description of Artificial Sequence: Synthetic polynucleotide
tgcatccggttgacccagtctccagccaccctgtctttgtctccaggggaaagagccaccctctcctgcagggccagtcagagtgttaccagctacttagcctggtaccaacagagacctggccaggctcccaggctcctcatctatgatacatccaacagggtcactggcgtcccagtcaggttcagtggcagtgggtatgggacagacttcactctcaccatcagcagcctagagcctgaggattttgcggtttattactgtcagcagcgtggcaacgggtacacctttggcccggggaccaaggtggaaatcaaa

SEQ ID NO: 5221-5301 - skipped (81 entries)

SEQ ID NO: 5302 - protein, 126 aa, Artificial Sequence
  Description of Artificial Sequence: Synthetic polypeptide
QVQLVQSGAEVKKPGSSVKVSCKASGGMFRDYAISWLRQAPGQRLEWMGGIMPAFGAPGYAQIFRGRATISADVSTTTAYLELTSLMPDDTAVYYCARDPSILNTGNHHWYDLDLWGQGTTVTVSS

SEQ ID NO: 5303 - protein, 26 aa, Artificial Sequence
  Description of Artificial Sequence: Synthetic peptide
QVQLVQSGAEVKKPGSSVKVSCKASG

SEQ ID NO: 5304 - protein, 9 aa, Artificial Sequence
  Description of Artificial Sequence: Synthetic peptide
GMFRDYAIS

SEQ ID NO: 5305 - protein, 14 aa, Artificial Sequence
  Description of Artificial Sequence: Synthetic peptide
WLRQAPGQRLEWMG

SEQ ID NO: 5306 - protein, 17 aa, Artificial Sequence
  Description of Artificial Sequence: Synthetic peptide
GIMPAFGAPGYAQIFRG

SEQ ID NO: 5307 - protein, 30 aa, Artificial Sequence
  Description of Artificial Sequence: Synthetic polypeptide
RATISADVSTTTAYLELTSLMPDDTAVYYC

SEQ ID NO: 5308 - protein, 19 aa, Artificial Sequence
  Description of Artificial Sequence: Synthetic peptide
ARDPSILNTGNHHWYDLDL

SEQ ID NO: 5309 - protein, 11 aa, Artificial Sequence
  Description of Artificial Sequence: Synthetic peptide
WGQGTTVTVSS

SEQ ID NO: 5310 - DNA, 378 bp, Artificial Sequence
  Description of Artificial Sequence: Synthetic polynucleotide
caggtccagctggtgcagtctggggctgaagtgaagaagcctgggtcctcggtgaaggtctcctgcaaggcttctggaggcatgttcagagactatgccatcagttggttgcgacaggcccctggacaacgacttgagtggatgggagggatcatgcctgcctttggtgcgccaggctacgcacagattttccggggcagagccaccatttccgcggacgtctccacgaccacggcctacttggaactgaccagcctgatgcctgacgacacggccgtgtattattgtgcgagagacccgtccattcttaacactgggaatcaccactggtatgatttagatctctggggccaagggaccacggtcactgtctcctca

SEQ ID NO: 5311 - skipped

SEQ ID NO: 5312 - protein, 112 aa, Artificial Sequence
  Description of Artificial Sequence: Synthetic polypeptide
ETTLTQSPLSLPVGLGQSASISCRSSQRVVHTDGNTYLNWFHQRPGQSPRRLIYKVSNRDSGVPDRFSGSGSGTDFTLRISRVEAEDVGVYYCMQATEWPRTFGQGTKVDIK

SEQ ID NO: 5313 - protein, 23 aa, Artificial Sequence
  Description of Artificial Sequence: Synthetic peptide
ETTLTQSPLSLPVGLGQSASISC

SEQ ID NO: 5314 - protein, 16 aa, Artificial Sequence
  Description of Artificial Sequence: Synthetic peptide
RSSQRVVHTDGNTYLN

SEQ ID NO: 5315 - protein, 15 aa, Artificial Sequence
  Description of Artificial Sequence: Synthetic peptide
WFHQRPGQSPRRLIY

SEQ ID NO: 5316 - protein, 7 aa, Artificial Sequence
  Description of Artificial Sequence: Synthetic peptide
KVSNRDS

SEQ ID NO: 5317 - protein, 32 aa, Artificial Sequence; identical to SEQ ID NO: 3517
  Description of Artificial Sequence: Synthetic polypeptide

SEQ ID NO: 5318 - protein, 9 aa, Artificial Sequence
  Description of Artificial Sequence: Synthetic peptide
MQATEWPRT

SEQ ID NO: 5319 - protein, 10 aa, Artificial Sequence
  Description of Artificial Sequence: Synthetic peptide
FGQGTKVDIK

SEQ ID NO: 5320 - DNA, 336 bp, Artificial Sequence
  Description of Artificial Sequence: Synthetic polynucleotide
gaaacgacactcacgcagtctccactctccctgcccgtcggcctcggacagtcggcctccatctcctgcaggtctagtcaaagggtcgttcacactgatgggaacacctacttgaattggtttcatcagaggccaggccaatctccaaggcgcctcatttataaggtttctaaccgggactccggggtcccagacagattcagcggcagcgggtcaggcactgatttcaccctgagaatcagcagggtggaggctgaggatgttggcgtttattactgcatgcaagctacagagtggccccggacgttcggccaagggaccaaagtggatatcaaa

SEQ ID NO: 5321-5401 - skipped (81 entries)

SEQ ID NO: 5402 - protein, 129 aa, Artificial Sequence
  Description of Artificial Sequence: Synthetic polypeptide
QVTLKESGAEVKKPGSSVKVSCKTSGGTFSTHAISWVRQAPGQGPEWMGGIIPLFGTSQHAQRFQARVKFTADESTNTAYMELSSLTPEDTAVYYCVRDSDPYTATSRNNHYWYGMDVWGHGTTVTVSS

SEQ ID NO: 5403 - protein, 26 aa, Artificial Sequence
  Description of Artificial Sequence: Synthetic peptide
QVTLKESGAEVKKPGSSVKVSCKTSG

SEQ ID NO: 5404 - protein, 9 aa, Artificial Sequence
  Description of Artificial Sequence: Synthetic peptide
GTFSTHAIS

SEQ ID NO: 5405 - protein, 14 aa, Artificial Sequence
  Description of Artificial Sequence: Synthetic peptide
WVRQAPGQGPEWMG

SEQ ID NO: 5406 - protein, 17 aa, Artificial Sequence
  Description of Artificial Sequence: Synthetic peptide
GIIPLFGTSQHAQRFQA

SEQ ID NO: 5407 - protein, 30 aa, Artificial Sequence
  Description of Artificial Sequence: Synthetic polypeptide
RVKFTADESTNTAYMELSSLTPEDTAVYYC

SEQ ID NO: 5408 - protein, 22 aa, Artificial Sequence
  Description of Artificial Sequence: Synthetic peptide
VRDSDPYTATSRNNHYWYGMDV

SEQ ID NO: 5409 - protein, 11 aa, Artificial Sequence
  Description of Artificial Sequence: Synthetic peptide
WGHGTTVTVSS

SEQ ID NO: 5410 - DNA, 387 bp, Artificial Sequence
  Description of Artificial Sequence: Synthetic polynucleotide
caggtcaccttgaaggagtctggggctgaggtgaagaagcctgggtcctcggtgaaggtctcctgcaagacttctggaggcaccttcagcacccatgctatcagttgggtgcgacaggcccctggacaagggcctgagtggatgggagggatcatccctctttttggaacctcacaacacgcacagaggttccaggccagagtcaagtttaccgcggacgagtccacgaacacagcctacatggagctgagcagcctgacacctgaagacacggccgtgtattattgtgtgagagactctgacccctatacggcgactagcaggaataatcactactggtatggtatggacgtctggggccatgggaccacggtcaccgtctcctca

SEQ ID NO: 5411 - skipped

SEQ ID NO: 5412 - protein, 112 aa, Artificial Sequence
  Description of Artificial Sequence: Synthetic polypeptide
EIVMTQSPLSLPVTLGQPASISCRSSQSVVHSDGNTYLNWFHQRPGQSPRRLIYKVSNRDSGVPDRFSGSGSGTDFTLKISRVEAEDIGVYYCMQGTDWPRTFGQGTKLEIK

SEQ ID NO: 5413 - protein, 23 aa, Artificial Sequence
  Description of Artificial Sequence: Synthetic peptide
EIVMTQSPLSLPVTLGQPASISC

SEQ ID NO: 5414 - protein, 16 aa, Artificial Sequence
  Description of Artificial Sequence: Synthetic peptide
RSSQSVVHSDGNTYLN

SEQ ID NO: 5415 - protein, 15 aa, Artificial Sequence
  Description of Artificial Sequence: Synthetic peptide
WFHQRPGQSPRRLIY

SEQ ID NO: 5416 - protein, 7 aa, Artificial Sequence
  Description of Artificial Sequence: Synthetic peptide
KVSNRDS

SEQ ID NO: 5417 - protein, 32 aa, Artificial Sequence; identical to SEQ ID NO: 1317
  Description of Artificial Sequence: Synthetic polypeptide

SEQ ID NO: 5418 - protein, 9 aa, Artificial Sequence
  Description of Artificial Sequence: Synthetic peptide
MQGTDWPRT

SEQ ID NO: 5419 - protein, 10 aa, Artificial Sequence
  Description of Artificial Sequence: Synthetic peptide
FGQGTKLEIK

SEQ ID NO: 5420 - DNA, 336 bp, Artificial Sequence
  Description of Artificial Sequence: Synthetic polynucleotide
gaaattgtgatgacacagtctccactctccctgcccgtcacccttggacagccggcctccatctcctgcaggtctagtcaaagcgtcgtacacagtgatggaaacacctacttgaattggtttcaccagaggccaggccaatctccaaggcgcctaatttataaggtttctaatcgggactctggggtcccagacagattcagcggcagtgggtcaggcactgacttcacactgaaaatcagcagggtggaggctgaggatattggagtttattactgcatgcaaggtacagactggcctcggacttttggccaggggaccaagctggagatcaaa

SEQ ID NO: 5421-5501 - skipped (81 entries)

SEQ ID NO: 5502 - protein, 126 aa, Artificial Sequence
  Description of Artificial Sequence: Synthetic polypeptide
QVQLVQSGAEVKKPGSSVKVSCKASGGMFSDYAISWVRQAPGQRLEWMGGIMPGLGSPAYAQSFGGRVTISADISTSTAYLEVTSLRPEDTAVYYCARDPSILNTGNHHWYDLDMWGQGTMVTVSS

SEQ ID NO: 5503 - protein, 26 aa, Artificial Sequence
  Description of Artificial Sequence: Synthetic peptide
QVQLVQSGAEVKKPGSSVKVSCKASG

SEQ ID NO: 5504 - protein, 9 aa, Artificial Sequence
  Description of Artificial Sequence: Synthetic peptide
GMFSDYAIS

SEQ ID NO: 5505 - protein, 14 aa, Artificial Sequence
  Description of Artificial Sequence: Synthetic peptide
WVRQAPGQRLEWMG

SEQ ID NO: 5506 - protein, 17 aa, Artificial Sequence
  Description of Artificial Sequence: Synthetic peptide
GIMPGLGSPAYAQSFGG

SEQ ID NO: 5507 - protein, 30 aa, Artificial Sequence; identical to SEQ ID NO: 5107
  Description of Artificial Sequence: Synthetic polypeptide

SEQ ID NO: 5508 - protein, 19 aa, Artificial Sequence
  Description of Artificial Sequence: Synthetic peptide
ARDPSILNTGNHHWYDLDM

SEQ ID NO: 5509 - protein, 11 aa, Artificial Sequence
  Description of Artificial Sequence: Synthetic peptide
WGQGTMVTVSS

SEQ ID NO: 5510 - DNA, 378 bp, Artificial Sequence
  Description of Artificial Sequence: Synthetic polynucleotide
caggtccagctggtgcagtctggggctgaggtgaagaagcctgggtcctcggtgaaggtctcctgcaaggcttctggaggcatgttcagtgactatgccatcagttgggtgcgacaggcccctggacaacgacttgagtggatgggagggatcatgcctggccttggttcgccagcctacgcacagagttttgggggcagagtcaccatttccgcggacatatccacgagcacggcctacctggaagtgaccagcctgaggcctgaggacacggccgtgtattactgtgcgagagacccgtccattcttaacactgggaatcaccactggtatgatttagatatgtggggccaagggacaatggtcaccgtctcctca

SEQ ID NO: 5511 - skipped

SEQ ID NO: 5512 - protein, 112 aa, Artificial Sequence
  Description of Artificial Sequence: Synthetic polypeptide
DIVMTQSPLSLPVDLGQSASISCRSSQTAVHTNGNTYLHWFHQRPGQAPRRLIYKVSNRESGVPDRFSGSGSGTDFTLRINRVEAEDVGVYYCMQATDWPRTFGQGTKLEIK

SEQ ID NO: 5513 - protein, 23 aa, Artificial Sequence
  Description of Artificial Sequence: Synthetic peptide
DIVMTQSPLSLPVDLGQSASISC

SEQ ID NO: 5514 - protein, 16 aa, Artificial Sequence
  Description of Artificial Sequence: Synthetic peptide
RSSQTAVHTNGNTYLH

SEQ ID NO: 5515 - protein, 15 aa, Artificial Sequence
  Description of Artificial Sequence: Synthetic peptide
WFHQRPGQAPRRLIY

SEQ ID NO: 5516 - protein, 7 aa, Artificial Sequence
  Description of Artificial Sequence: Synthetic peptide
KVSNRES

SEQ ID NO: 5517 - protein, 32 aa, Artificial Sequence
  Description of Artificial Sequence: Synthetic polypeptide
GVPDRFSGSGSGTDFTLRINRVEAEDVGVYYC

SEQ ID NO: 5518 - protein, 9 aa, Artificial Sequence
  Description of Artificial Sequence: Synthetic peptide
MQATDWPRT

SEQ ID NO: 5519 - protein, 10 aa, Artificial Sequence
  Description of Artificial Sequence: Synthetic peptide
FGQGTKLEIK

SEQ ID NO: 5520 - DNA, 336 bp, Artificial Sequence
  Description of Artificial Sequence: Synthetic polynucleotide
gatattgtgatgactcagtctccactctccctgcccgtcgacctcggacagtcggcctccatctcctgcaggtctagtcaaacggccgtgcacactaatgggaacacctacttgcattggtttcaccagaggccaggccaagctccaaggcgcctcatttataaggtttctaaccgggagtccggggtcccagacagattcagcggcagtgggtcaggcactgatttcaccctgagaatcaacagggtggaggctgaggatgttggcgtttattactgcatgcaagctacagactggcctcggacgttcggccaagggaccaagctggagatcaaa

SEQ ID NO: 5521-5601 - skipped (81 entries)

SEQ ID NO: 5602 - protein, 125 aa, Artificial Sequence
  Description of Artificial Sequence: Synthetic polypeptide
QVQLVQSGAEVKKPGSSMKLSCKASGINFRSYSFSWVRQAPGQGLEWMGGVIPYFPTANYAEKFRGRVTATADESTGTVYLEMSSLRSEDTAVYYCASEYFDGRSYHSFCGLDVWGQGTPVTVSS

SEQ ID NO: 5603 - protein, 26 aa, Artificial Sequence
  Description of Artificial Sequence: Synthetic peptide
QVQLVQSGAEVKKPGSSMKLSCKASG

SEQ ID NO: 5604 - protein, 9 aa, Artificial Sequence
  Description of Artificial Sequence: Synthetic peptide
INFRSYSFS

SEQ ID NO: 5605 - protein, 14 aa, Artificial Sequence
  Description of Artificial Sequence: Synthetic peptide
WVRQAPGQGLEWMG

SEQ ID NO: 5606 - protein, 17 aa, Artificial Sequence
  Description of Artificial Sequence: Synthetic peptide
GVIPYFPTANYAEKFRG

SEQ ID NO: 5607 - protein, 30 aa, Artificial Sequence; identical to SEQ ID NO: 907
  Description of Artificial Sequence: Synthetic polypeptide

SEQ ID NO: 5608 - protein, 18 aa, Artificial Sequence
  Description of Artificial Sequence: Synthetic peptide
ASEYFDGRSYHSFCGLDV

SEQ ID NO: 5609 - protein, 11 aa, Artificial Sequence
  Description of Artificial Sequence: Synthetic peptide
WGQGTPVTVSS

SEQ ID NO: 5610 - DNA, 375 bp, Artificial Sequence
  Description of Artificial Sequence: Synthetic polynucleotide
caggtccagcttgtacagtctggggctgaggtgaagaagcctgggtcttcgatgaagctctcctgcaaggcttctgggatcaactttaggagttattctttcagctgggtgcgacaggcccctggacaaggacttgagtggatgggcggcgtcatcccttactttccgacagcgaactacgcagagaaattccggggcagggtcacggctaccgcggacgagtccacgggcacagtgtacttggagatgagcagcctgcgatctgaagacacggccgtctactattgtgcgagcgagtactttgatggtcgttcttaccactccttctgcggcttggacgtctggggccaagggaccccggtcaccgtctcctca

SEQ ID NO: 5611 - skipped

SEQ ID NO: 5612 - protein, 112 aa, Artificial Sequence
  Description of Artificial Sequence: Synthetic polypeptide
DNDITQSPLSLPVTLGQPASISCRSSQGLVHSNGNTYLNWFHQRPGQSPRRLIYQVSNRDSGVPDRFSGSGSGTDFTLKISRVEAEDVGVYYCMQGTEWPRTFGQGTKVDIK

SEQ ID NO: 5613 - protein, 23 aa, Artificial Sequence
  Description of Artificial Sequence: Synthetic peptide
DNDITQSPLSLPVTLGQPASISC

SEQ ID NO: 5614 - protein, 16 aa, Artificial Sequence
  Description of Artificial Sequence: Synthetic peptide
RSSQGLVHSNGNTYLN

SEQ ID NO: 5615 - protein, 15 aa, Artificial Sequence
  Description of Artificial Sequence: Synthetic peptide
WFHQRPGQSPRRLIY

SEQ ID NO: 5616 - protein, 7 aa, Artificial Sequence
  Description of Artificial Sequence: Synthetic peptide
QVSNRDS

SEQ ID NO: 5617 - protein, 32 aa, Artificial Sequence; identical to SEQ ID NO: 917
  Description of Artificial Sequence: Synthetic polypeptide

SEQ ID NO: 5618 - protein, 9 aa, Artificial Sequence
  Description of Artificial Sequence: Synthetic peptide
MQGTEWPRT

SEQ ID NO: 5619 - protein, 10 aa, Artificial Sequence
  Description of Artificial Sequence: Synthetic peptide
FGQGTKVDIK

SEQ ID NO: 5620 - DNA, 336 bp, Artificial Sequence
  Description of Artificial Sequence: Synthetic polynucleotide
gataatgacatcacgcagtctccactctctctgcccgtcacccttggacagccggcctccatctcctgcaggtctagtcaaggcctcgtacacagtaatggaaacacctacttgaattggtttcaccagaggccaggccaatctccaaggcgcctaatttatcaagtttctaatcgggactctggggtcccagacagattcagcggcagtgggtcaggcactgatttcacactgaaaataagcagggtggaggctgaggatgttggggtttattactgcatgcaaggcacagaatggcctcggacgttcggccaagggaccaaagtggatatcaaa

SEQ ID NO: 5621-5701 - skipped (81 entries)

SEQ ID NO: 5702 - protein, 126 aa, Artificial Sequence
  Description of Artificial Sequence: Synthetic polypeptide
QVQLVQSGAEVKKPGSSVKVSCKASGGMFSDYAISWVRQAPGQRLEWMGGIMPGLGSPAYAQIFRGRVTISADISTSTAYLEVTSLRPEDTAVYYCARDPSILNTGNHHWYDLDMWGQGTTVTVSS

SEQ ID NO: 5703 - protein, 26 aa, Artificial Sequence
  Description of Artificial Sequence: Synthetic peptide
QVQLVQSGAEVKKPGSSVKVSCKASG

SEQ ID NO: 5704 - protein, 9 aa, Artificial Sequence
  Description of Artificial Sequence: Synthetic peptide
GMFSDYAIS

SEQ ID NO: 5705 - protein, 14 aa, Artificial Sequence
  Description of Artificial Sequence: Synthetic peptide
WVRQAPGQRLEWMG

SEQ ID NO: 5706 - protein, 17 aa, Artificial Sequence
  Description of Artificial Sequence: Synthetic peptide
GIMPGLGSPAYAQIFRG

SEQ ID NO: 5707 - protein, 30 aa, Artificial Sequence; identical to SEQ ID NO: 5107
  Description of Artificial Sequence: Synthetic polypeptide

SEQ ID NO: 5708 - protein, 19 aa, Artificial Sequence
  Description of Artificial Sequence: Synthetic peptide
ARDPSILNTGNHHWYDLDM

SEQ ID NO: 5709 - protein, 11 aa, Artificial Sequence
  Description of Artificial Sequence: Synthetic peptide
WGQGTTVTVSS

SEQ ID NO: 5710 - DNA, 378 bp, Artificial Sequence
  Description of Artificial Sequence: Synthetic polynucleotide
caggtccagctggtgcagtctggggctgaggtgaagaagcctgggtcctcggtgaaggtctcctgcaaggcttctggaggcatgttcagtgactatgccatcagttgggtgcgacaggcccctggacaacgacttgagtggatgggagggatcatgcctggccttggttcgccagcctacgcacagatttttcggggcagagtcaccatttccgcggacatatccacgagcacggcctacctggaagtgaccagcctgaggcctgaggacacggccgtgtattactgtgcgagagacccgtctattcttaacactgggaatcaccactggtatgatttagatatgtggggccaagggaccacggtcaccgtctcctca

SEQ ID NO: 5711 - skipped

SEQ ID NO: 5712 - protein, 112 aa, Artificial Sequence
  Description of Artificial Sequence: Synthetic polypeptide
DIQMTQSPLSLPVDLGQSASISCRSSQRVVHTNGNTYLHWFHQRPGQAPRRLIYKVSNRESGVPDRFSGSGSGTDFTLRISRVEAEDVGVYYCMQATDWPRTFGQGTKVEIK

SEQ ID NO: 5713 - protein, 23 aa, Artificial Sequence
  Description of Artificial Sequence: Synthetic peptide
DIQMTQSPLSLPVDLGQSASISC

SEQ ID NO: 5714 - protein, 16 aa, Artificial Sequence
  Description of Artificial Sequence: Synthetic peptide
RSSQRVVHTNGNTYLH

SEQ ID NO: 5715 - protein, 15 aa, Artificial Sequence
  Description of Artificial Sequence: Synthetic peptide
WFHQRPGQAPRRLIY

SEQ ID NO: 5716 - protein, 7 aa, Artificial Sequence
  Description of Artificial Sequence: Synthetic peptide
KVSNRES

SEQ ID NO: 5717 - protein, 32 aa, Artificial Sequence; identical to SEQ ID NO: 3517
  Description of Artificial Sequence: Synthetic polypeptide

SEQ ID NO: 5718 - protein, 9 aa, Artificial Sequence
  Description of Artificial Sequence: Synthetic peptide
MQATDWPRT

SEQ ID NO: 5719 - protein, 10 aa, Artificial Sequence
  Description of Artificial Sequence: Synthetic peptide
FGQGTKVEIK

SEQ ID NO: 5720 - DNA, 336 bp, Artificial Sequence
  Description of Artificial Sequence: Synthetic polynucleotide
gacatccagatgacccagtctccactctccctgcccgtcgacctcggacagtcggcctccatctcctgcaggtctagtcaaagggtcgtgcacactaatgggaacacctacttgcattggtttcaccagaggccaggccaagctccaaggcgcctcatttataaggtttctaaccgggagtccggggtcccagacagattcagcggcagtgggtcaggcactgatttcaccctgagaatcagcagggtggaggctgaggatgttggcgtttattactgcatgcaagctacagactggcctcggacgttcggccaagggaccaaggtggaaatcaaa

SEQ ID NO: 5721-5801 - skipped (81 entries)

SEQ ID NO: 5802 - protein, 122 aa, Artificial Sequence
  Description of Artificial Sequence: Synthetic polypeptide
EVQLVESGGGLVQPGGSLRLSCLTSGFSFSSYWMIWVRQAPGKGLEWVANIEPDGNEEYYVDSVKGRFTISRDNAKNSLYLQMNSLRAEDTAVYYCARGPIRHFGLDAFDIWGQGTTVTVSS

SEQ ID NO: 5803 - protein, 26 aa, Artificial Sequence
  Description of Artificial Sequence: Synthetic peptide
EVQLVESGGGLVQPGGSLRLSCLTSG

SEQ ID NO: 5804 - protein, 9 aa, Artificial Sequence
  Description of Artificial Sequence: Synthetic peptide
FSFSSYWMI

SEQ ID NO: 5805 - protein, 14 aa, Artificial Sequence
  Description of Artificial Sequence: Synthetic peptide
WVRQAPGKGLEWVA

SEQ ID NO: 5806 - protein, 17 aa, Artificial Sequence
  Description of Artificial Sequence: Synthetic peptide
NIEPDGNEEYYVDSVKG

SEQ ID NO: 5807 - protein, 30 aa, Artificial Sequence
  Description of Artificial Sequence: Synthetic polypeptide
RFTISRDNAKNSLYLQMNSLRAEDTAVYYC

SEQ ID NO: 5808 - protein, 15 aa, Artificial Sequence
  Description of Artificial Sequence: Synthetic peptide
ARGPIRHFGLDAFDI

SEQ ID NO: 5809 - protein, 11 aa, Artificial Sequence
  Description of Artificial Sequence: Synthetic peptide
WGQGTTVTVSS

SEQ ID NO: 5810 - DNA, 366 bp, Artificial Sequence
  Description of Artificial Sequence: Synthetic polynucleotide
gaggtgcagctggtggagtctgggggaggcttggtccagcctggggggtccctgagactctcctgtttaacctctggattctcctttagtagttattggatgatctgggtccgccaggctccagggaaggggctggagtgggtggccaacatagagccagatggaaatgaggaatactatgtggactctgtgaagggccgattcaccatctccagagacaacgccaagaattcattgtatctgcagatgaacagcctgagagcggaggacacggccgtgtattactgtgcgagaggaccgatccgacattttggccttgatgcttttgatatctggggccaagggaccacggtcaccgtctcctca

SEQ ID NO: 5811 - skipped

SEQ ID NO: 5812 - protein, 113 aa, Artificial Sequence
  Description of Artificial Sequence: Synthetic polypeptide
QPGLTQPASVSGSPGQSITISCTRTSGDVGDYNSVSWYVSWYQQHPGRAPKLMLYDVSNRPSGVSNRFSGSKLGDTASLTISELQAEDEADYYCSTYTSTSTIFGGGTKLTVL

SEQ ID NO: 5813 - protein, 22 aa, Artificial Sequence
  Description of Artificial Sequence: Synthetic peptide
QPGLTQPASVSGSPGQSITISC

SEQ ID NO: 5814 - protein, 18 aa, Artificial Sequence
  Description of Artificial Sequence: Synthetic peptide
TRTSGDVGDYNSVSWYVS

SEQ ID NO: 5815 - protein, 15 aa, Artificial Sequence
  Description of Artificial Sequence: Synthetic peptide
WYQQHPGRAPKLMLY

SEQ ID NO: 5816 - protein, 7 aa, Artificial Sequence
  Description of Artificial Sequence: Synthetic peptide
DVSNRPS

SEQ ID NO: 5817 - protein, 32 aa, Artificial Sequence
  Description of Artificial Sequence: Synthetic polypeptide
GVSNRFSGSKLGDTASLTISELQAEDEADYYC

SEQ ID NO: 5818 - protein, 9 aa, Artificial Sequence
  Description of Artificial Sequence: Synthetic peptide
STYTSTSTI

SEQ ID NO: 5819 - protein, 10 aa, Artificial Sequence
  Description of Artificial Sequence: Synthetic peptide
FGGGTKLTVL

SEQ ID NO: 5820 - DNA, 339 bp, Artificial Sequence
  Description of Artificial Sequence: Synthetic polynucleotide
cagcctgggctgactcagcctgcctccgtgtctgggtctcctggacagtcgatcaccatctcctgcactagaaccagcggtgacgttggtgattataactctgtctcctggtatgtctcctggtaccaacaacacccaggcagagcccccaaactcatgctttatgatgtcagtaatcggccctcaggggtctctaatcgcttctctggctccaaacttggcgacacggcctccctgaccatctctgaactccaggctgaggacgaggctgattattactgcagcacatatacaagcaccagcacgatattcggcggagggaccaagctgaccgtccta

SEQ ID NO: 5821-5901 - skipped (81 entries)

SEQ ID NO: 5902 - protein, 129 aa, Artificial Sequence
  Description of Artificial Sequence: Synthetic polypeptide
QVQLVQSGDEMKKPGSSVKVSCKASGDTFSTHAISWVRQAPGQGPEWMGGIIPLFGTASYAQTSQSRVKITADESTSTAYMELSSLTSEDTAVYYCVRDSDPYTATSRNNHYWYGMDVWGQGTTVTVSS

SEQ ID NO: 5903 - protein, 26 aa, Artificial Sequence
  Description of Artificial Sequence: Synthetic peptide
QVQLVQSGDEMKKPGSSVKVSCKASG

SEQ ID NO: 5904 - protein, 9 aa, Artificial Sequence
  Description of Artificial Sequence: Synthetic peptide
DTFSTHAIS

SEQ ID NO: 5905 - protein, 14 aa, Artificial Sequence
  Description of Artificial Sequence: Synthetic peptide
WVRQAPGQGPEWMG

SEQ ID NO: 5906 - protein, 17 aa, Artificial Sequence
  Description of Artificial Sequence: Synthetic peptide
GIIPLFGTASYAQTSQS

SEQ ID NO: 5907 - protein, 30 aa, Artificial Sequence
  Description of Artificial Sequence: Synthetic polypeptide
RVKITADESTSTAYMELSSLTSEDTAVYYC

SEQ ID NO: 5908 - protein, 22 aa, Artificial Sequence
  Description of Artificial Sequence: Synthetic peptide
VRDSDPYTATSRNNHYWYGMDV

SEQ ID NO: 5909 - protein, 11 aa, Artificial Sequence
  Description of Artificial Sequence: Synthetic peptide
WGQGTTVTVSS

SEQ ID NO: 5910 - DNA, 387 bp, Artificial Sequence
  Description of Artificial Sequence: Synthetic polynucleotide
caggtccagctggtgcagtctggggatgagatgaagaagcctgggtcctcggtgaaggtctcctgcaaggcttctggagacaccttcagcacccatgctatcagctgggtgcgacaggcccctggacaagggcctgagtggatgggagggatcatccctctttttggcacagcaagttacgcacagacgtcgcagagcagagtcaagattaccgcggacgagtccacgagcacagcctacatggagctgagcagcctgacatctgaagacacggccgtgtattattgtgtgagagactctgacccctatacggcgaccagcaggaataatcactattggtatggaatggacgtctggggccaagggaccacggtcaccgtctcctca

SEQ ID NO: 5911 - skipped

SEQ ID NO: 5912 - protein, 112 aa, Artificial Sequence
  Description of Artificial Sequence: Synthetic polypeptide
DIQMTQSPLSLPVTLGQPASISCRASQTVVHTNGNTYLNWFHQRPGQSPRRLIYEVSNRDSGVPDRFSGSGSGTDFTLSISRVEAEDIGVYYCMQGTDWPRTFGPGTKVEIK

SEQ ID NO: 5913 - protein, 23 aa, Artificial Sequence
  Description of Artificial Sequence: Synthetic peptide
DIQMTQSPLSLPVTLGQPASISC

SEQ ID NO: 5914 - protein, 16 aa, Artificial Sequence
  Description of Artificial Sequence: Synthetic peptide
RASQTVVHTNGNTYLN

SEQ ID NO: 5915 - protein, 15 aa, Artificial Sequence
  Description of Artificial Sequence: Synthetic peptide
WFHQRPGQSPRRLIY

SEQ ID NO: 5916 - protein, 7 aa, Artificial Sequence
  Description of Artificial Sequence: Synthetic peptide
EVSNRDS

SEQ ID NO: 5917 - protein, 32 aa, Artificial Sequence
  Description of Artificial Sequence: Synthetic polypeptide
GVPDRFSGSGSGTDFTLSISRVEAEDIGVYYC

SEQ ID NO: 5918 - protein, 9 aa, Artificial Sequence
  Description of Artificial Sequence: Synthetic peptide
MQGTDWPRT

SEQ ID NO: 5919 - protein, 10 aa, Artificial Sequence
  Description of Artificial Sequence: Synthetic peptide
FGPGTKVEIK

SEQ ID NO: 5920 - DNA, 336 bp, Artificial Sequence
  Description of Artificial Sequence: Synthetic polynucleotide
gacatccagatgacccagtctccgctctccctgcccgtcacccttggacagccggcctccatctcctgcagggctagtcaaaccgtcgtgcacactaatggaaacacctacttgaattggtttcaccagaggccaggccaatctccgaggcgcctaatttatgaggtttctaatcgggactctggggtcccagacagattcagcggcagtgggtcaggcactgacttcacactgagcatcagcagggtggaggctgaggatattggggtttattactgcatgcaaggtacagactggcctcggacttttggcccggggaccaaggtggaaatcaaa

SEQ ID NO: 5921-6001 - skipped (81 entries)

SEQ ID NO: 6002 - protein, 126 aa, Artificial Sequence; identical to SEQ ID NO: 5502
  Description of Artificial Sequence: Synthetic polypeptide

SEQ ID NO: 6003 - protein, 26 aa, Artificial Sequence
  Description of Artificial Sequence: Synthetic peptide
QVQLVQSGAEVKKPGSSVKVSCKASG

SEQ ID NO: 6004 - protein, 9 aa, Artificial Sequence
  Description of Artificial Sequence: Synthetic peptide
GMFSDYAIS

SEQ ID NO: 6005 - protein, 14 aa, Artificial Sequence
  Description of Artificial Sequence: Synthetic peptide
WVRQAPGQRLEWMG

SEQ ID NO: 6006 - protein, 17 aa, Artificial Sequence
  Description of Artificial Sequence: Synthetic peptide
GIMPGLGSPAYAQSFGG

SEQ ID NO: 6007 - protein, 30 aa, Artificial Sequence; identical to SEQ ID NO: 5107
  Description of Artificial Sequence: Synthetic polypeptide

SEQ ID NO: 6008 - protein, 19 aa, Artificial Sequence
  Description of Artificial Sequence: Synthetic peptide
ARDPSILNTGNHHWYDLDM

SEQ ID NO: 6009 - protein, 11 aa, Artificial Sequence
  Description of Artificial Sequence: Synthetic peptide
WGQGTMVTVSS

SEQ ID NO: 6010 - DNA, 378 bp, Artificial Sequence
  Description of Artificial Sequence: Synthetic polynucleotide
caggtccagctggtgcaatctggggctgaggtgaagaagcctgggtcctcggtgaaggtctcctgcaaggcttctggaggcatgttcagtgactatgccatcagttgggtgcgacaggcccctggacaacgacttgagtggatgggagggatcatgcctggccttggttcgccagcctacgcacagagttttgggggcagagtcaccatttccgcggacatatccacgagcacggcctacctggaagtgaccagcctgaggcctgaggacacggccgtgtattactgtgcgagagacccgtccattcttaacactgggaatcaccactggtatgatttagatatgtggggccaagggacaatggtcaccgtctcctca

SEQ ID NO: 6011 - skipped

SEQ ID NO: 6012 - protein, 112 aa, Artificial Sequence
  Description of Artificial Sequence: Synthetic polypeptide
DIRLTQSPLSLPVDLGQSASISCRSSQTVVHTNGNTYLHWFHQRPGQAPRRLIYKVSNRESGVPDRFSGSGSGTDFTLRISRVEAEDVGVYYCMQATDWPRTFGQGTKVDIK

SEQ ID NO: 6013 - protein, 23 aa, Artificial Sequence
  Description of Artificial Sequence: Synthetic peptide
DIRLTQSPLSLPVDLGQSASISC

SEQ ID NO: 6014 - protein, 16 aa, Artificial Sequence
  Description of Artificial Sequence: Synthetic peptide
RSSQTVVHTNGNTYLH

SEQ ID NO: 6015 - protein, 15 aa, Artificial Sequence
  Description of Artificial Sequence: Synthetic peptide
WFHQRPGQAPRRLIY

SEQ ID NO: 6016 - protein, 7 aa, Artificial Sequence
  Description of Artificial Sequence: Synthetic peptide
KVSNRES

SEQ ID NO: 6017 - protein, 32 aa, Artificial Sequence; identical to SEQ ID NO: 3517
  Description of Artificial Sequence: Synthetic polypeptide

SEQ ID NO: 6018 - protein, 9 aa, Artificial Sequence
  Description of Artificial Sequence: Synthetic peptide
MQATDWPRT

SEQ ID NO: 6019 - protein, 10 aa, Artificial Sequence
  Description of Artificial Sequence: Synthetic peptide
FGQGTKVDIK

SEQ ID NO: 6020 - DNA, 336 bp, Artificial Sequence
  Description of Artificial Sequence: Synthetic polynucleotide
gacatccggttgacacagtctccactctccctgcccgtcgacctcggacagtcggcctccatctcctgcaggtctagtcaaacggtcgtgcacactaatgggaacacctacttgcattggtttcaccagaggccaggccaagctccaaggcgcctcatttataaggtttctaaccgggagtccggggtcccagacagattcagcggcagtgggtcaggcactgatttcaccctgagaatcagcagggtggaggctgaggatgttggcgtttattactgcatgcaagctacagactggcctcggacgttcggccaagggaccaaagtggatatcaaa

SEQ ID NO: 6021-6101 - skipped (81 entries)

SEQ ID NO: 6102 - protein, 122 aa, Artificial Sequence
  Description of Artificial Sequence: Synthetic polypeptide
EVQLVESGGGLVQPGGSLRLSCSASGFTFSNYAMYWVRQAPGKRPEYVSGISSNGGITYYADSVEGRFTVSRDNSKKSLYLQMSSLRPEDTAVYYCVKDLGATVTYDVFDVWGQGTMVTVSS

SEQ ID NO: 6103 - protein, 26 aa, Artificial Sequence
  Description of Artificial Sequence: Synthetic peptide
EVQLVESGGGLVQPGGSLRLSCSASG

SEQ ID NO: 6104 - protein, 9 aa, Artificial Sequence
  Description of Artificial Sequence: Synthetic peptide
FTFSNYAMY

SEQ ID NO: 6105 - protein, 14 aa, Artificial Sequence
  Description of Artificial Sequence: Synthetic peptide
WVRQAPGKRPEYVS

SEQ ID NO: 6106 - protein, 17 aa, Artificial Sequence
  Description of Artificial Sequence: Synthetic peptide
GISSNGGITYYADSVEG

SEQ ID NO: 6107 - protein, 30 aa, Artificial Sequence
  Description of Artificial Sequence: Synthetic polypeptide
RFTVSRDNSKKSLYLQMSSLRPEDTAVYYC

SEQ ID NO: 6108 - protein, 15 aa, Artificial Sequence
  Description of Artificial Sequence: Synthetic peptide
VKDLGATVTYDVFDV

SEQ ID NO: 6109 - protein, 11 aa, Artificial Sequence
  Description of Artificial Sequence: Synthetic peptide
WGQGTMVTVSS

SEQ ID NO: 6110 - DNA, 366 bp, Artificial Sequence
  Description of Artificial Sequence: Synthetic polynucleotide
gaggtgcagctggtggagtctgggggaggcttggtccagcctggggggtccctgagactctcctgttcagcctctggattcaccttcagtaattatgctatgtactgggtccgccaggctccagggaagagaccggaatatgtctcagggattagtagtaatgggggtatcacatactacgcagactccgtggagggcagattcaccgtctccagagacaattccaagaaatccctgtatcttcaaatgagcagtctgagacctgaggacacggctgtgtattactgtgtgaaagatctgggggctacggtgacttatgatgtttttgatgtctggggccaagggacaatggtcaccgtctcctca

SEQ ID NO: 6111 - skipped

SEQ ID NO: 6112 - protein, 107 aa, Artificial Sequence
  Description of Artificial Sequence: Synthetic polypeptide
DIRVTQSPSSLSATVGDRVTITCRASQTITKYLNWYQQKPGKAPKLLLYGASSLQSGVPSRFSGSGSGTDFTLTISSLQPEDFATYYCQQTYITPGTFGQGTRLEIK

SEQ ID NO: 6113 - protein, 23 aa, Artificial Sequence
  Description of Artificial Sequence: Synthetic peptide
DIRVTQSPSSLSATVGDRVTITC

SEQ ID NO: 6114 - protein, 11 aa, Artificial Sequence
  Description of Artificial Sequence: Synthetic peptide
RASQTITKYLN

SEQ ID NO: 6115 - protein, 15 aa, Artificial Sequence
  Description of Artificial Sequence: Synthetic peptide
WYQQKPGKAPKLLLY

SEQ ID NO: 6116 - protein, 7 aa, Artificial Sequence
  Description of Artificial Sequence: Synthetic peptide
GASSLQS

SEQ ID NO: 6117 - protein, 32 aa, Artificial Sequence; identical to SEQ ID NO: 517
  Description of Artificial Sequence: Synthetic polypeptide

SEQ ID NO: 6118 - protein, 9 aa, Artificial Sequence
  Description of Artificial Sequence: Synthetic peptide
QQTYITPGT

SEQ ID NO: 6119 - protein, 10 aa, Artificial Sequence
  Description of Artificial Sequence: Synthetic peptide
FGQGTRLEIK

SEQ ID NO: 6120 - DNA, 321 bp, Artificial Sequence
  Description of Artificial Sequence: Synthetic polynucleotide
gacatccgggtgacccagtctccatcctccctgtctgcaactgtaggagacagagtcaccatcacttgccgggcaagtcagaccattaccaaatatttaaattggtatcagcagaaaccagggaaagcccctaaactcctgctctatggggcatccagtttgcaaagtggggtcccatcaaggttcagtggcagtggatctgggacagatttcactctcaccatcagcagtctgcaacctgaggattttgcaacttactactgtcaacagacttacattacccctggcaccttcggccaagggacacgactggagattaaa

SEQ ID NO: 6121-6201 - skipped (81 entries)

SEQ ID NO: 6202 - protein, 120 aa, Artificial Sequence
  Description of Artificial Sequence: Synthetic polypeptide
EVQLVESGGGLVQPGGSLRLSCAASGFTFSSYSMSWVRQAPGKGLEWVSGHDGGTTHYADSVKGRFTISRDDSMNTLSLQMNSLRAEDTAVYYCAKERDLPGRGGYFDHWGQGTLVTVSS

SEQ ID NO: 6203 - protein, 26 aa, Artificial Sequence
  Description of Artificial Sequence: Synthetic peptide
EVQLVESGGGLVQPGGSLRLSCAASG

SEQ ID NO: 6204 - protein, 9 aa, Artificial Sequence
  Description of Artificial Sequence: Synthetic peptide
FTFSSYSMS

SEQ ID NO: 6205 - protein, 14 aa, Artificial Sequence
  Description of Artificial Sequence: Synthetic peptide
WVRQAPGKGLEWVS

SEQ ID NO: 6206 - protein, 15 aa, Artificial Sequence
  Description of Artificial Sequence: Synthetic peptide
GHDGGTTHYADSVKG

SEQ ID NO: 6207 - protein, 30 aa, Artificial Sequence
  Description of Artificial Sequence: Synthetic polypeptide
RFTISRDDSMNTLSLQMNSLRAEDTAVYYC

SEQ ID NO: 6208 - protein, 15 aa, Artificial Sequence
  Description of Artificial Sequence: Synthetic peptide
AKERDLPGRGGYFDH

SEQ ID NO: 6209 - protein, 11 aa, Artificial Sequence
  Description of Artificial Sequence: Synthetic peptide
WGQGTLVTVSS

SEQ ID NO: 6210 - DNA, 360 bp, Artificial Sequence
  Description of Artificial Sequence: Synthetic polynucleotide
gaggtgcagctggtggagtctgggggaggcttggtacagcctggggggtccctgagactctcctgtgcagcctctggattcacctttagcagctattccatgagctgggtccgccaggctccagggaaggggctggagtgggtctcaggtcatgatggtgggaccacacactacgcagactccgtgaagggccggttcaccatctccagagacgattccatgaacacgctgtctctgcaaatgaacagcctgagagccgaggacacggccgtatattactgtgcgaaagagcgtgatctgccgggccgggggggatactttgaccactggggccagggaaccctggtcaccgtctcctca

SEQ ID NO: 6211 - skipped

SEQ ID NO: 6212 - protein, 113 aa, Artificial Sequence
  Description of Artificial Sequence: Synthetic polypeptide
DIRLTQSPDSLALSLGERATINCKSSQSVLFSSNNNNYLGWYQQKPGQPPKLLIYWASTRESGVPDRFSGSGSGTDFTLTISSLQAEDVAVYYCQQYYLTPWTFGQGTKVDIK

SEQ ID NO: 6213 - protein, 23 aa, Artificial Sequence
  Description of Artificial Sequence: Synthetic peptide
DIRLTQSPDSLALSLGERATINC

SEQ ID NO: 6214 - protein, 17 aa, Artificial Sequence
  Description of Artificial Sequence: Synthetic peptide
KSSQSVLFSSNNNNYLG

SEQ ID NO: 6215 - protein, 15 aa, Artificial Sequence
  Description of Artificial Sequence: Synthetic peptide
WYQQKPGQPPKLLIY

SEQ ID NO: 6216 - protein, 7 aa, Artificial Sequence
  Description of Artificial Sequence: Synthetic peptide
WASTRES

SEQ ID NO: 6217 - protein, 32 aa, Artificial Sequence; identical to SEQ ID NO: 1617
  Description of Artificial Sequence: Synthetic polypeptide

SEQ ID NO: 6218 - protein, 9 aa, Artificial Sequence
  Description of Artificial Sequence: Synthetic peptide
QQYYLTPWT

SEQ ID NO: 6219 - protein, 10 aa, Artificial Sequence
  Description of Artificial Sequence: Synthetic peptide
FGQGTKVDIK

SEQ ID NO: 6220 - DNA, 339 bp, Artificial Sequence
  Description of Artificial Sequence: Synthetic polynucleotide
gacatccggttgacccagtctccagactccctggctctgtctctgggcgagagggccaccatcaactgcaagtccagccagagtgttttattcagctccaacaataacaattacttaggttggtaccagcagaaaccaggacagcctcctaaattactcatttactgggcatctacccgggaatccggggtccctgaccgattcagtggcagcgggtctgggacagacttcactctcaccatcagcagcctgcaggctgaagatgtggcagtttattactgtcagcaatattatcttactccgtggacgttcggccaagggaccaaagtggatatcaaa

SEQ ID NO: 6221-6301 - skipped (81 entries)

SEQ ID NO: 6302 - protein, 129 aa, Artificial Sequence
  Description of Artificial Sequence: Synthetic polypeptide
QVQLQQWGAGLLKPSETLSLTCAVYGGSFRGFYWTWIRQPPGKGLEWIGEVSHSGETNYNPSLKSRVTISVDTSKNQFSLNLISVTAADTSVYYCARGYTAPIIREVPITFRPRWFDPWGQGTPVTVSS

SEQ ID NO: 6303 - protein, 26 aa, Artificial Sequence
  Description of Artificial Sequence: Synthetic peptide
QVQLQQWGAGLLKPSETLSLTCAVYG

SEQ ID NO: 6304 - protein, 9 aa, Artificial Sequence
  Description of Artificial Sequence: Synthetic peptide
GSFRGFYWT

SEQ ID NO: 6305 - protein, 14 aa, Artificial Sequence
  Description of Artificial Sequence: Synthetic peptide
WIRQPPGKGLEWIG

SEQ ID NO: 6306 - protein, 16 aa, Artificial Sequence
  Description of Artificial Sequence: Synthetic peptide
EVSHSGETNYNPSLKS

SEQ ID NO: 6307 - protein, 30 aa, Artificial Sequence
  Description of Artificial Sequence: Synthetic polypeptide
RVTISVDTSKNQFSLNLISVTAADTSVYYC

SEQ ID NO: 6308 - protein, 23 aa, Artificial Sequence
  Description of Artificial Sequence: Synthetic peptide
ARGYTAPIIREVPITFRPRWFDP

SEQ ID NO: 6309 - protein, 11 aa, Artificial Sequence
  Description of Artificial Sequence: Synthetic peptide
WGQGTPVTVSS

SEQ ID NO: 6310 - DNA, 387 bp, Artificial Sequence
  Description of Artificial Sequence: Synthetic polynucleotide
caggtgcagctacagcagtggggcgcgggactgttgaagccttcggagaccctgtccctcacctgcgctgtctatggtgggtccttcaggggtttctactggacctggatccgccagcccccagggaaggggctggagtggattggggaagtcagtcacagtggagaaaccaactacaacccgtccctcaagagtcgagtcaccatatcagtagacacgtccaagaaccagttctccctgaacctcatctctgtgaccgccgcggacacgtctgtgtactattgtgcgagaggctatacggctccaatcattcgggaagttcctatcacattccgcccccggtggttcgacccctggggccaggggaccccggtcaccgtctcttca

SEQ ID NO: 6311 - skipped

SEQ ID NO: 6312 - protein, 110 aa, Artificial Sequence
  Description of Artificial Sequence: Synthetic polypeptide
QPVLTQPASVSGSPGQSITISCTGTSSDVGNYNVVSWYQQHPGKAPQLFIYEDTKRPSGVSDRFSGSKSGITASLTISRLQPEDEADYYCCSYAVSGTVLFGGGTKVTVL

SEQ ID NO: 6313 - protein, 22 aa, Artificial Sequence
  Description of Artificial Sequence: Synthetic peptide
QPVLTQPASVSGSPGQSITISC

SEQ ID NO: 6314 - protein, 14 aa, Artificial Sequence
  Description of Artificial Sequence: Synthetic peptide
TGTSSDVGNYNVVS

SEQ ID NO: 6315 - protein, 15 aa, Artificial Sequence
  Description of Artificial Sequence: Synthetic peptide
WYQQHPGKAPQLFIY

SEQ ID NO: 6316 - protein, 7 aa, Artificial Sequence
  Description of Artificial Sequence: Synthetic peptide
EDTKRPS

SEQ ID NO: 6317 - protein, 32 aa, Artificial Sequence
  Description of Artificial Sequence: Synthetic polypeptide
GVSDRFSGSKSGITASLTISRLQPEDEADYYC

SEQ ID NO: 6318 - protein, 10 aa, Artificial Sequence
  Description of Artificial Sequence: Synthetic peptide
CSYAVSGTVL

SEQ ID NO: 6319 - protein, 10 aa, Artificial Sequence
  Description of Artificial Sequence: Synthetic peptide
FGGGTKVTVL

SEQ ID NO: 6320 - DNA, 330 bp, Artificial Sequence
  Description of Artificial Sequence: Synthetic polynucleotide
cagcctgtgctgactcagcctgcctccgtgtcggggtctcctggacagtcgatcaccatctcctgcactggaaccagcagtgatgttgggaattataacgttgtctcttggtaccaacaacacccaggcaaagccccccaactcttcatttatgaggacactaaacggccctcaggggtttctgatcgcttctctggctccaagtctggcatcacggcctccctgacaatctctcgactccagcctgaggacgaggctgattattactgctgctcatatgcagtaagtggcactgtgctttttggcggagggaccaaggtgaccgtccta

SEQ ID NO: 6321-6401 - skipped (81 entries)

SEQ ID NO: 6402 - protein, 120 aa, Artificial Sequence
  Description of Artificial Sequence: Synthetic polypeptide
QVQLVQSGGGVVNPGGSMRLSCAGSGFTFSDHYMGWIRQAPGKGLEVISYISSSGSFIRDADSVKGRFTISRDNAKNSVYLQMNSLRAEDTAVYYCARMGPYGSGTFDYWGQGTLVTVSS

SEQ ID NO: 6403 - protein, 26 aa, Artificial Sequence
  Description of Artificial Sequence: Synthetic peptide
QVQLVQSGGGVVNPGGSMRLSCAGSG

SEQ ID NO: 6404 - protein, 9 aa, Artificial Sequence
  Description of Artificial Sequence: Synthetic peptide
FTFSDHYMG

SEQ ID NO: 6405 - protein, 14 aa, Artificial Sequence
  Description of Artificial Sequence: Synthetic peptide
WIRQAPGKGLEVIS

SEQ ID NO: 6406 - protein, 17 aa, Artificial Sequence
  Description of Artificial Sequence: Synthetic peptide
YISSSGSFIRDADSVKG

SEQ ID NO: 6407 - protein, 30 aa, Artificial Sequence
  Description of Artificial Sequence: Synthetic polypeptide
RFTISRDNAKNSVYLQMNSLRAEDTAVYYC

SEQ ID NO: 6408 - protein, 13 aa, Artificial Sequence
  Description of Artificial Sequence: Synthetic peptide
ARMGPYGSGTFDY

SEQ ID NO: 6409 - protein, 11 aa, Artificial Sequence
  Description of Artificial Sequence: Synthetic peptide
WGQGTLVTVSS

SEQ ID NO: 6410 - DNA, 360 bp, Artificial Sequence
  Description of Artificial Sequence: Synthetic polynucleotide
caggtccagcttgtacagtctgggggaggcgtggtcaaccctggagggtccatgagactctcctgtgcaggctctggattcactttcagtgaccactacatgggttggatccgccaggctccagggaaggggctggaggtgatttcatacattagtagttctgggtcctttataagggacgcagactctgtgaagggccgattcaccatctcccgagacaacgccaagaattcagtgtatctgcaaatgaacagcctgagggccgaagacacggctgtctattactgtgcgagaatgggcccctatggttcggggacctttgactactggggccagggaaccctggtcaccgtctcttca

SEQ ID NO: 6411 - skipped

SEQ ID NO: 6412 - protein, 107 aa, Artificial Sequence
  Description of Artificial Sequence: Synthetic polypeptide
EIVLTQSPGTLSVSPGERATLSCRASQIINRSQLGWYQHKPGQAPRLLIFDSSKRATGTPDRFSASGSETDFTLTISGVEPEDSGVYYCLQYSLATTFGPGTKVDIK

SEQ ID NO: 6413 - protein, 23 aa, Artificial Sequence
  Description of Artificial Sequence: Synthetic peptide
EIVLTQSPGTLSVSPGERATLSC

SEQ ID NO: 6414 - protein, 12 aa, Artificial Sequence
  Description of Artificial Sequence: Synthetic peptide
RASQIINRSQLG

SEQ ID NO: 6415 - protein, 15 aa, Artificial Sequence
  Description of Artificial Sequence: Synthetic peptide
WYQHKPGQAPRLLIF

SEQ ID NO: 6416 - protein, 7 aa, Artificial Sequence
  Description of Artificial Sequence: Synthetic peptide
DSSKRAT

SEQ ID NO: 6417 - protein, 32 aa, Artificial Sequence
  Description of Artificial Sequence: Synthetic polypeptide
GTPDRFSASGSETDFTLTISGVEPEDSGVYYC

SEQ ID NO: 6418 - protein, 8 aa, Artificial Sequence
  Description of Artificial Sequence: Synthetic peptide
LQYSLATT

SEQ ID NO: 6419 - protein, 10 aa, Artificial Sequence
  Description of Artificial Sequence: Synthetic peptide
FGPGTKVDIK

SEQ ID NO: 6420 - DNA, 321 bp, Artificial Sequence
  Description of Artificial Sequence: Synthetic polynucleotide
gaaattgtgttgacgcagtctccaggcaccctgtctgtgtctccaggggaaagagccaccctctcctgcagggccagtcagattattaatagaagtcagttaggctggtatcagcacaaacctggccaggctcccaggctcctcatctttgattcatctaagagggccactggcaccccagacaggtttagtgccagtgggtctgagactgacttcactctcactattagtggagtggagcctgaggattctggggtttattactgtctccagtatagtcttgcaacgacgttcggcccagggaccaaagtggatatcaaa

SEQ ID NO: 6421-6501 - skipped (81 entries)

SEQ ID NO: 6502 - protein, 123 aa, Artificial Sequence
  Description of Artificial Sequence: Synthetic polypeptide
QVQLVQSGGNVVQPGGSLRLSCVGSEFSITFFAMQWVRRTPGKGLEWVALVSHDGSNIRYSDSVKGRFIISRDNAKNTLYLQLDSLTPEDTGIYYCARDHALQNGRPGYFDSWGQGSQVTVSS

SEQ ID NO: 6503 - protein, 26 aa, Artificial Sequence
  Description of Artificial Sequence: Synthetic peptide
QVQLVQSGGNVVQPGGSLRLSCVGSE

SEQ ID NO: 6504 - protein, 9 aa, Artificial Sequence
  Description of Artificial Sequence: Synthetic peptide
FSITFFAMQ

SEQ ID NO: 6505 - protein, 14 aa, Artificial Sequence
  Description of Artificial Sequence: Synthetic peptide
WVRRTPGKGLEWVA

SEQ ID NO: 6506 - protein, 17 aa, Artificial Sequence
  Description of Artificial Sequence: Synthetic peptide
LVSHDGSNIRYSDSVKG

SEQ ID NO: 6507 - protein, 30 aa, Artificial Sequence
  Description of Artificial Sequence: Synthetic polypeptide
RFIISRDNAKNTLYLQLDSLTPEDTGIYYC

SEQ ID NO: 6508 - protein, 16 aa, Artificial Sequence
  Description of Artificial Sequence: Synthetic peptide
ARDHALQNGRPGYFDS

SEQ ID NO: 6509 - protein, 11 aa, Artificial Sequence
  Description of Artificial Sequence: Synthetic peptide
WGQGSQVTVSS

SEQ ID NO: 6510 - DNA, 369 bp, Artificial Sequence
  Description of Artificial Sequence: Synthetic polynucleotide
caggtccagcttgtgcagtctgggggaaacgtggtccagccgggggggtccctgagactctcctgtgtagggtctgaattcagtatcacttttttcgctatgcaatgggtccgccggactccaggcaaggggctggagtgggtggctcttgtgtcacatgatggcagcaacataagatattcagactccgtgaagggccgatttatcatctccagagacaacgccaagaacacactatatctgcaactggacagcctgacacctgaagacacgggtatttattactgtgcgagagatcatgctctccaaaatggccggcccgggtactttgactcctggggccagggatcccaggtcaccgtctcctca

SEQ ID NO: 6511 - skipped

SEQ ID NO: 6512 - protein, 106 aa, Artificial Sequence
  Description of Artificial Sequence: Synthetic polypeptide
DIQLTQSPATLSLSPGERATLSCRASPSVFTFLAWYQQRPGQPPRLLIHDVSNRAPGIPARFSGSGSGTDFTLIISSLEPDDSAVYFCQQRSDGYNFGPGTKVDIK

SEQ ID NO: 6513 - protein, 23 aa, Artificial Sequence
  Description of Artificial Sequence: Synthetic peptide
DIQLTQSPATLSLSPGERATLSC

SEQ ID NO: 6514 - protein, 11 aa, Artificial Sequence
  Description of Artificial Sequence: Synthetic peptide
RASPSVFTFLA

SEQ ID NO: 6515 - protein, 15 aa, Artificial Sequence
  Description of Artificial Sequence: Synthetic peptide
WYQQRPGQPPRLLIH

SEQ ID NO: 6516 - protein, 7 aa, Artificial Sequence
  Description of Artificial Sequence: Synthetic peptide
DVSNRAP

SEQ ID NO: 6517 - protein, 32 aa, Artificial Sequence
  Description of Artificial Sequence: Synthetic polypeptide
GIPARFSGSGSGTDFTLIISSLEPDDSAVYFC

SEQ ID NO: 6518 - protein, 8 aa, Artificial Sequence
  Description of Artificial Sequence: Synthetic peptide
QQRSDGYN

SEQ ID NO: 6519 - protein, 10 aa, Artificial Sequence
  Description of Artificial Sequence: Synthetic peptide
FGPGTKVDIK

SEQ ID NO: 6520 - DNA, 318 bp, Artificial Sequence
  Description of Artificial Sequence: Synthetic polynucleotide
gacatccagttgacccagtctccagccaccctgtctttgtctccaggggaaagagccaccctctcctgccgggccagtccgagtgttttcaccttcttagcctggtaccaacaaagacctggccagcctcccaggctcctcattcatgatgtatccaacagggcccctggcatcccagccaggttcagtggcagtgggtctgggacagacttcactctcatcatcagcagcctcgagcctgacgactctgcagtctacttctgtcagcagcgtagtgacgggtacaattttggcccggggaccaaagtggatatcaaa

SEQ ID NO: 6521-6601 - skipped (81 entries)

SEQ ID NO: 6602 - protein, 121 aa, Artificial Sequence
  Description of Artificial Sequence: Synthetic polypeptide
QVQLVQSGGGLVQPGGSLRLSCSASGFTFNTYAMHWVRQAPGKRLEYVSSITRDGAGKFYADSVKGRFTISRDNSKNTLYQQMSSLRPEDTAVYYCVREGQQWLGLYFDHWGQGALVTVSS

SEQ ID NO: 6603 - protein, 26 aa, Artificial Sequence
  Description of Artificial Sequence: Synthetic peptide
QVQLVQSGGGLVQPGGSLRLSCSASG

SEQ ID NO: 6604 - protein, 9 aa, Artificial Sequence
  Description of Artificial Sequence: Synthetic peptide
FTFNTYAMH

SEQ ID NO: 6605 - protein, 14 aa, Artificial Sequence
  Description of Artificial Sequence: Synthetic peptide
WVRQAPGKRLEYVS

SEQ ID NO: 6606 - protein, 17 aa, Artificial Sequence
  Description of Artificial Sequence: Synthetic peptide
SITRDGAGKFYADSVKG

SEQ ID NO: 6607 - protein, 30 aa, Artificial Sequence
  Description of Artificial Sequence: Synthetic polypeptide
RFTISRDNSKNTLYQQMSSLRPEDTAVYYC

SEQ ID NO: 6608 - protein, 14 aa, Artificial Sequence
  Description of Artificial Sequence: Synthetic peptide
VREGQQWLGLYFDH

SEQ ID NO: 6609 - protein, 11 aa, Artificial Sequence
  Description of Artificial Sequence: Synthetic peptide
WGQGALVTVSS

SEQ ID NO: 6610 - DNA, 363 bp, Artificial Sequence
  Description of Artificial Sequence: Synthetic polynucleotide
caggtccagctggtgcagtctgggggaggcttggtccagcccggggggtccctgagactctcctgttcagcctccggattcaccttcaacacctacgctatgcactgggtccgccaggctccaggaaagagactggaatatgtttcatctattactagagatggggctggcaaattctacgcagactccgtgaagggtagattcaccatctccagagacaattccaagaacacattatatcaacaaatgagcagtctgagacctgaggacaccgctgtgtattactgtgtgagagaggggcagcagtggttgggcctttattttgaccattggggccagggagccctggtcaccgtctcctca

SEQ ID NO: 6611 - skipped

SEQ ID NO: 6612 - protein, 108 aa, Artificial Sequence
  Description of Artificial Sequence: Synthetic polypeptide
DIRVTQSPSSLSASVGDRVTITCRASQTINNYLNWYQQKPGKAPNLLIYAASTLQNGVPSRFSGSGSGTDFTLTISSVQPEDFATYYCQQTYITPTWTFGQGTKVEIK

SEQ ID NO: 6613 - protein, 23 aa, Artificial Sequence
  Description of Artificial Sequence: Synthetic peptide
DIRVTQSPSSLSASVGDRVTITC

SEQ ID NO: 6614 - protein, 11 aa, Artificial Sequence
  Description of Artificial Sequence: Synthetic peptide
RASQTINNYLN

SEQ ID NO: 6615 - protein, 15 aa, Artificial Sequence
  Description of Artificial Sequence: Synthetic peptide
WYQQKPGKAPNLLIY

SEQ ID NO: 6616 - protein, 7 aa, Artificial Sequence
  Description of Artificial Sequence: Synthetic peptide
AASTLQN

SEQ ID NO: 6617 - protein, 32 aa, Artificial Sequence
  Description of Artificial Sequence: Synthetic polypeptide
GVPSRFSGSGSGTDFTLTISSVQPEDFATYYC

SEQ ID NO: 6618 - protein, 10 aa, Artificial Sequence
  Description of Artificial Sequence: Synthetic peptide
QQTYITPTWT

SEQ ID NO: 6619 - protein, 10 aa, Artificial Sequence
  Description of Artificial Sequence: Synthetic peptide
FGQGTKVEIK

SEQ ID NO: 6620 - DNA, 324 bp, Artificial Sequence
  Description of Artificial Sequence: Synthetic polynucleotide
gacatccgggtgacccagtctccatcctccctgtctgcatctgtaggagacagagtcaccatcacttgccgggcaagtcagaccattaacaactatttaaattggtatcagcaaaaaccagggaaagcccctaacctcctgatctatgctgcatccactttgcaaaatggggtcccatcaaggttcagtggcagtggatctgggacagatttcactctcaccatcagcagtgtacaacctgaagattttgcaacttactactgtcaacagacttacattacccctacgtggacgttcggccaagggaccaaggtggaaatcaaa

SEQ ID NO: 6621-6701 - skipped (81 entries)

SEQ ID NO: 6702 - protein, 127 aa, Artificial Sequence
  Description of Artificial Sequence: Synthetic polypeptide
EVQLVQSGAEMKKPGESLKISCKGSGYSFPNYWIGWVRQMPGKGLEWMAIMWPSDSDTRYSPSFQGQVTISADTSTSTVYLQWGSLKASDTAMYYCVRQRYCSGGSCFLFEDAFEIWGQGTMVTVSS

SEQ ID NO: 6703 - protein, 26 aa, Artificial Sequence
  Description of Artificial Sequence: Synthetic peptide
EVQLVQSGAEMKKPGESLKISCKGSG

SEQ ID NO: 6704 - protein, 9 aa, Artificial Sequence
  Description of Artificial Sequence: Synthetic peptide
YSFPNYWIG

SEQ ID NO: 6705 - protein, 14 aa, Artificial Sequence
  Description of Artificial Sequence: Synthetic peptide
WVRQMPGKGLEWMA

SEQ ID NO: 6706 - protein, 17 aa, Artificial Sequence
  Description of Artificial Sequence: Synthetic peptide
IMWPSDSDTRYSPSFQG

SEQ ID NO: 6707 - protein, 30 aa, Artificial Sequence
  Description of Artificial Sequence: Synthetic polypeptide
QVTISADTSTSTVYLQWGSLKASDTAMYYC

SEQ ID NO: 6708 - protein, 20 aa, Artificial Sequence
  Description of Artificial Sequence: Synthetic peptide
VRQRYCSGGSCFLFEDAFEI

SEQ ID NO: 6709 - protein, 11 aa, Artificial Sequence
  Description of Artificial Sequence: Synthetic peptide
WGQGTMVTVSS

SEQ ID NO: 6710 - DNA, 381 bp, Artificial Sequence
  Description of Artificial Sequence: Synthetic polynucleotide
gaggtccagcttgtgcagtctggagcagagatgaaaaagcccggggagtctctgaagatctcttgtaagggttctggatacagctttcccaactactggatcggctgggtgcgccagatgcccgggaaaggcctggagtggatggccattatgtggcctagtgactctgataccagatacagtccgtccttccaaggccaggtcaccatctcagccgacacgtccaccagcaccgtctacctgcagtggggcagcctgaaggcctcggacaccgccatgtattactgtgtgaggcagagatattgtagtggtggtagctgcttcctctttgaagatgcttttgaaatctggggccaagggacaatggtcaccgtctcctca

SEQ ID NO: 6711 - skipped

SEQ ID NO: 6712 - protein, 106 aa, Artificial Sequence
  Description of Artificial Sequence: Synthetic polypeptide
EIVLTQSPSTLSASVGDRVTITCRASQNVNNWLAWYQQKPGKAPKLLIYEASTLKSGVPSRFSGSGSGTEFTLTISSLQPDDFATYYCQQYNSQYTFGQGTKVDIK

SEQ ID NO: 6713 - protein, 23 aa, Artificial Sequence
  Description of Artificial Sequence: Synthetic peptide
EIVLTQSPSTLSASVGDRVTITC

SEQ ID NO: 6714 - protein, 11 aa, Artificial Sequence
  Description of Artificial Sequence: Synthetic peptide
RASQNVNNWLA

SEQ ID NO: 6715 - protein, 15 aa, Artificial Sequence
  Description of Artificial Sequence: Synthetic peptide
WYQQKPGKAPKLLIY

SEQ ID NO: 6716 - protein, 7 aa, Artificial Sequence
  Description of Artificial Sequence: Synthetic peptide
EASTLKS

SEQ ID NO: 6717 - protein, 32 aa, Artificial Sequence
  Description of Artificial Sequence: Synthetic polypeptide
GVPSRFSGSGSGTEFTLTISSLQPDDFATYYC

SEQ ID NO: 6718 - protein, 8 aa, Artificial Sequence
  Description of Artificial Sequence: Synthetic peptide
QQYNSQYT

SEQ ID NO: 6719 - protein, 10 aa, Artificial Sequence
  Description of Artificial Sequence: Synthetic peptide
FGQGTKVDIK

SEQ ID NO: 6720 - DNA, 318 bp, Artificial Sequence
  Description of Artificial Sequence: Synthetic polynucleotide
gaaattgtattgacgcagtctccttccaccctgtctgcatctgtaggagacagagtcaccatcacttgccgggccagtcagaatgtaaataattggttggcctggtatcagcaaaaaccagggaaagcccctaagctcctgatttatgaggcgtctactttaaaaagtggggtcccatcgaggttcagcggcagtgggtctgggacagaattcactctcaccatcagcagcctgcagcctgatgattttgcaacttattactgccaacagtataatagccaatacacttttggccaggggaccaaagtggatatcaaa

SEQ ID NO: 6721-6801 - skipped (81 entries)

SEQ ID NO: 6802 - protein, 117 aa, Artificial Sequence
  Description of Artificial Sequence: Synthetic polypeptide
EVQLVESGGGLVQPGGSLRLSCAASGFIFKNEPMNWIRQFPGKGLEWISNIRDNGNDVYYADSVKGRFTVSRDNAKNSLYLQMNSLRDDDTALYYCVRDTDWAFDSWGQGTLVTVSS

SEQ ID NO: 6803 - protein, 26 aa, Artificial Sequence
  Description of Artificial Sequence: Synthetic peptide
EVQLVESGGGLVQPGGSLRLSCAASG

SEQ ID NO: 6804 - protein, 9 aa, Artificial Sequence
  Description of Artificial Sequence: Synthetic peptide
FIFKNEPMN

SEQ ID NO: 6805 - protein, 14 aa, Artificial Sequence
  Description of Artificial Sequence: Synthetic peptide
WIRQFPGKGLEWIS

SEQ ID NO: 6806 - protein, 17 aa, Artificial Sequence
  Description of Artificial Sequence: Synthetic peptide
NIRDNGNDVYYADSVKG

SEQ ID NO: 6807 - protein, 30 aa, Artificial Sequence
  Description of Artificial Sequence: Synthetic polypeptide
RFTVSRDNAKNSLYLQMNSLRDDDTALYYC

SEQ ID NO: 6808 - protein, 10 aa, Artificial Sequence
  Description of Artificial Sequence: Synthetic peptide
VRDTDWAFDS

SEQ ID NO: 6809 - protein, 11 aa, Artificial Sequence
  Description of Artificial Sequence: Synthetic peptide
WGQGTLVTVSS

SEQ ID NO: 6810 - DNA, 351 bp, Artificial Sequence
  Description of Artificial Sequence: Synthetic polynucleotide
gaggtgcagctggtggagtctgggggaggcttggtacagccgggggggtccctgagactctcttgtgcagcctctggattcatcttcaaaaacgagcccatgaactggatccgccagttcccagggaagggactggagtggatttcaaatattagagacaatggaaatgatgtttactacgcggactctgtgaagggccgattcaccgtctccagagacaatgccaagaattcactgtatctgcaaatgaacagcctaagagacgacgacacggctttgtattattgtgtgagagacacagactgggcctttgactcctggggccagggaaccctggtcaccgtctcctca

SEQ ID NO: 6811 - skipped

SEQ ID NO: 6812 - protein, 110 aa, Artificial Sequence
  Description of Artificial Sequence: Synthetic polypeptide
QPVLTQPRSVSGSPGQSVTISCTGSSSTFGTDNHISWYQQLPGKVPKLIIHAVSQRPSVVPDRFSGSRSGNTASLTISGLQAEDEADYYCCSSPGTITWVFGGGTKVTVL

SEQ ID NO: 6813 - protein, 22 aa, Artificial Sequence
  Description of Artificial Sequence: Synthetic peptide
QPVLTQPRSVSGSPGQSVTISC

SEQ ID NO: 6814 - protein, 14 aa, Artificial Sequence
  Description of Artificial Sequence: Synthetic peptide
TGSSSTFGTDNHIS

SEQ ID NO: 6815 - protein, 15 aa, Artificial Sequence
  Description of Artificial Sequence: Synthetic peptide
WYQQLPGKVPKLIIH

SEQ ID NO: 6816 - protein, 7 aa, Artificial Sequence
  Description of Artificial Sequence: Synthetic peptide
AVSQRPS

SEQ ID NO: 6817 - protein, 32 aa, Artificial Sequence
  Description of Artificial Sequence: Synthetic polypeptide
VVPDRFSGSRSGNTASLTISGLQAEDEADYYC

SEQ ID NO: 6818 - protein, 10 aa, Artificial Sequence
  Description of Artificial Sequence: Synthetic peptide
CSSPGTITWV

SEQ ID NO: 6819 - protein, 10 aa, Artificial Sequence
  Description of Artificial Sequence: Synthetic peptide
FGGGTKVTVL

SEQ ID NO: 6820 - DNA, 330 bp, Artificial Sequence
  Description of Artificial Sequence: Synthetic polynucleotide
cagcctgtgctgactcagcctcgctcagtgtccgggtctcctggacagtcagtcaccatctcctgcactggaagcagcagtacttttggcactgataaccatatctcctggtaccaacaactcccaggcaaagtccccaaactcatcattcatgctgtcagtcaacggccctcagttgtccctgatcgcttctctgggtccaggtctggcaacacggcctccctgaccatctctggcctccaggctgaagatgaggctgattattactgctgttcatcgcctggcacaataacgtgggtgtttggcggagggaccaaggtcaccgtccta

SEQ ID NO: 6821-6901 - skipped (81 entries)

SEQ ID NO: 6902 - protein, 125 aa, Artificial Sequence
  Description of Artificial Sequence: Synthetic polypeptide
EVQLVESGPTLVKPTQTLTLTCTFSGFSLTTRRQGVGWLRRPPGKALEWLALIYWDDDKRYSPSLKSRLTITKDTSKNHVVLSLTNVGPADTATYYCAHTSELPPRRPYAAFDFWGQGTLVTVSS

SEQ ID NO: 6903 - protein, 26 aa, Artificial Sequence
  Description of Artificial Sequence: Synthetic peptide
EVQLVESGPTLVKPTQTLTLTCTFSG

SEQ ID NO: 6904 - protein, 11 aa, Artificial Sequence
  Description of Artificial Sequence: Synthetic peptide
FSLTTRRQGVG

SEQ ID NO: 6905 - protein, 14 aa, Artificial Sequence
  Description of Artificial Sequence: Synthetic peptide
WLRRPPGKALEWLA

SEQ ID NO: 6906 - protein, 16 aa, Artificial Sequence
  Description of Artificial Sequence: Synthetic peptide
LIYWDDDKRYSPSLKS

SEQ ID NO: 6907 - protein, 30 aa, Artificial Sequence
  Description of Artificial Sequence: Synthetic polypeptide
RLTITKDTSKNHVVLSLTNVGPADTATYYC

SEQ ID NO: 6908 - protein, 17 aa, Artificial Sequence
  Description of Artificial Sequence: Synthetic peptide
AHTSELPPRRPYAAFDF

SEQ ID NO: 6909 - protein, 11 aa, Artificial Sequence
  Description of Artificial Sequence: Synthetic peptide
WGQGTLVTVSS

SEQ ID NO: 6910 - DNA, 375 bp, Artificial Sequence
  Description of Artificial Sequence: Synthetic polynucleotide
gaggtgcagctggtggagtctggtcctacgctggtgaaacccacacagaccctcacgctgacctgcaccttctctggtttctcactcaccactagacgacagggtgtgggctggctccgtcggcccccaggaaaggccctggagtggcttgcactcatttattgggatgatgataagcgctacagtccatctctgaagagcagactcaccatcaccaaggacacctccaaaaaccacgtagtcctgtcactgaccaacgtgggccctgctgacacggccacatattactgtgcacacacctcagagttgcccccccgacgaccgtatgccgcctttgacttctggggccagggaaccctggtcactgtctcctca

SEQ ID NO: 6911 - skipped

SEQ ID NO: 6912 - protein, 110 aa, Artificial Sequence
  Description of Artificial Sequence: Synthetic polypeptide
QSVLTQPPSVSGVPRQKVTISCSGSTANIASNGVNWYQLVPGKAPRLLISYDDLVPSGVSARFSGSKSGTSASLAISGLQAEDEADYYCATWDDILNGPVFGGGTKLTVL

SEQ ID NO: 6913 - protein, 22 aa, Artificial Sequence
  Description of Artificial Sequence: Synthetic peptide
QSVLTQPPSVSGVPRQKVTISC

SEQ ID NO: 6914 - protein, 13 aa, Artificial Sequence
  Description of Artificial Sequence: Synthetic peptide
SGSTANIASNGVN

SEQ ID NO: 6915 - protein, 15 aa, Artificial Sequence
  Description of Artificial Sequence: Synthetic peptide
WYQLVPGKAPRLLIS

SEQ ID NO: 6916 - protein, 7 aa, Artificial Sequence
  Description of Artificial Sequence: Synthetic peptide
YDDLVPS

SEQ ID NO: 6917 - protein, 32 aa, Artificial Sequence
  Description of Artificial Sequence: Synthetic polypeptide
GVSARFSGSKSGTSASLAISGLQAEDEADYYC

SEQ ID NO: 6918 - protein, 11 aa, Artificial Sequence
  Description of Artificial Sequence: Synthetic peptide
ATWDDILNGPV

SEQ ID NO: 6919 - protein, 10 aa, Artificial Sequence
  Description of Artificial Sequence: Synthetic peptide
FGGGTKLTVL

SEQ ID NO: 6920 - DNA, 330 bp, Artificial Sequence
  Description of Artificial Sequence: Synthetic polynucleotide
cagtctgtcctgacgcagccgccctcggtgtctggagtccccaggcagaaggtcaccatctcctgttctggaagcaccgccaacatcgcaagcaatggtgtgaactggtaccaactggtcccaggaaaggctcccagactcctcatctcttatgatgatctggtgccctcaggggtctctgcccgattctctggctccaagtctggcacctcagcctccctggccatcagtgggctccaggctgaagatgaggctgattattattgtgcgacgtgggatgacatcctgaatggtccggtattcggcggagggaccaagctgaccgtccta

SEQ ID NO: 6921-7001 - skipped (81 entries)

SEQ ID NO: 7002 - protein, 115 aa, Artificial Sequence
  Description of Artificial Sequence: Synthetic polypeptide
EVQLLESGGGLVQPGGSLRLSCAASGFPFSTDAMNWVRQAPGEGLEWVSTISDSGRDTYYAASVRGRFTISRDNSKNTVYLQMNSLRVEDTAVYYCANTNFLDYWGQGTLVTVSS

SEQ ID NO: 7003 - protein, 26 aa, Artificial Sequence
  Description of Artificial Sequence: Synthetic peptide
EVQLLESGGGLVQPGGSLRLSCAASG

SEQ ID NO: 7004 - protein, 9 aa, Artificial Sequence
  Description of Artificial Sequence: Synthetic peptide
FPFSTDAMN

SEQ ID NO: 7005 - protein, 14 aa, Artificial Sequence
  Description of Artificial Sequence: Synthetic peptide
WVRQAPGEGLEWVS

SEQ ID NO: 7006 - protein, 17 aa, Artificial Sequence
  Description of Artificial Sequence: Synthetic peptide
TISDSGRDTYYAASVRG

SEQ ID NO: 7007 - protein, 30 aa, Artificial Sequence
  Description of Artificial Sequence: Synthetic polypeptide
RFTISRDNSKNTVYLQMNSLRVEDTAVYYC

SEQ ID NO: 7008 - protein, 8 aa, Artificial Sequence
  Description of Artificial Sequence: Synthetic peptide
ANTNFLDY

SEQ ID NO: 7009 - protein, 11 aa, Artificial Sequence
  Description of Artificial Sequence: Synthetic peptide
WGQGTLVTVSS

SEQ ID NO: 7010 - DNA, 345 bp, Artificial Sequence
  Description of Artificial Sequence: Synthetic polynucleotide
gaggtgcagctgttggagtctggggggggcttggtgcagccgggggggtccctgagactctcctgtgcagcctctggattcccctttagcaccgatgccatgaactgggtccgccaggctccaggggaggggctggagtgggtctcaactattagtgatagtggtcgtgacacatactacgcagcctccgtgaggggccggttcaccatttccagagacaattccaagaacacagtttatctgcaaatgaacagcctgagagtcgaggacacggccgtgtattactgtgcgaatactaatttccttgactactggggccagggaaccctggtcaccgtctcttca

SEQ ID NO: 7011 - skipped

SEQ ID NO: 7012 - protein, 112 aa, Artificial Sequence
  Description of Artificial Sequence: Synthetic polypeptide
DIVLTQSPLSLPVTLGQSASISCRSSQGLVHSDGNIYLNWFQQRPGQSPRRLIYKVSNRDSGVPDRFSGSGSGTDFTLKISRVEAEDVGLYYCMQATHWPRAFGQGTKLEIK

SEQ ID NO: 7013 - protein, 23 aa, Artificial Sequence
  Description of Artificial Sequence: Synthetic peptide
DIVLTQSPLSLPVTLGQSASISC

SEQ ID NO: 7014 - protein, 16 aa, Artificial Sequence
  Description of Artificial Sequence: Synthetic peptide
RSSQGLVHSDGNIYLN

SEQ ID NO: 7015 - protein, 15 aa, Artificial Sequence
  Description of Artificial Sequence: Synthetic peptide
WFQQRPGQSPRRLIY

SEQ ID NO: 7016 - protein, 7 aa, Artificial Sequence
  Description of Artificial Sequence: Synthetic peptide
KVSNRDS

SEQ ID NO: 7017 - protein, 32 aa, Artificial Sequence
  Description of Artificial Sequence: Synthetic polypeptide
GVPDRFSGSGSGTDFTLKISRVEAEDVGLYYC

SEQ ID NO: 7018 - protein, 9 aa, Artificial Sequence
  Description of Artificial Sequence: Synthetic peptide
MQATHWPRA

SEQ ID NO: 7019 - protein, 10 aa, Artificial Sequence
  Description of Artificial Sequence: Synthetic peptide
FGQGTKLEIK

SEQ ID NO: 7020 - DNA, 336 bp, Artificial Sequence
  Description of Artificial Sequence: Synthetic polynucleotide
gatattgtgctgacgcagtctccactctccctgcccgtcacccttggacagtcggcctccatctcctgcaggtctagtcaaggcctcgtacacagtgatggaaacatctatttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttgggctttattactgcatgcaagctacacactggcctcgagcgttcggccaagggaccaagctggagatcaaa

SEQ ID NO: 7021-7101 - skipped (81 entries)

SEQ ID NO: 7102 - protein, 128 aa, Artificial Sequence; identical to SEQ ID NO: 2402
  Description of Artificial Sequence: Synthetic polypeptide

SEQ ID NO: 7103 - protein, 26 aa, Artificial Sequence
  Description of Artificial Sequence: Synthetic peptide
EVQLVESGGGLVQPGGSLRLSCAASG

SEQ ID NO: 7104 - protein, 9 aa, Artificial Sequence
  Description of Artificial Sequence: Synthetic peptide
FTFSTSAMS

SEQ ID NO: 7105 - protein, 14 aa, Artificial Sequence
  Description of Artificial Sequence: Synthetic peptide
WVRQAPGKGLEWVS

SEQ ID NO: 7106 - protein, 17 aa, Artificial Sequence
  Description of Artificial Sequence: Synthetic peptide
RIGGGGGRTKYADSVKG

SEQ ID NO: 7107 - protein, 30 aa, Artificial Sequence; identical to SEQ ID NO: 2407
  Description of Artificial Sequence: Synthetic polypeptide

SEQ ID NO: 7108 - protein, 21 aa, Artificial Sequence
  Description of Artificial Sequence: Synthetic peptide
AKCDLVRYFDWLGEENNWFDP

SEQ ID NO: 7109 - protein, 11 aa, Artificial Sequence
  Description of Artificial Sequence: Synthetic peptide
WGQGTLVTVSS

SEQ ID NO: 7110 - DNA, 384 bp, Artificial Sequence; identical to SEQ ID NO: 2410
  Description of Artificial Sequence: Synthetic polynucleotide

SEQ ID NO: 7111-7201 - skipped (91 entries)

SEQ ID NO: 7202 - protein, 127 aa, Artificial Sequence
  Description of Artificial Sequence: Synthetic polypeptide
EVQLQESGPGLLKPSETLSLTCTVSGSPIASNYWSWVRQPAGKGLEWIGRIDTSPTTDYNPSLKSRVIMSVDTSTSQFSLKMSSVTAADTAVYYCTRSFISFDSSGHPYYYYAMDVWGQGTTVTVSS

SEQ ID NO: 7203 - protein, 26 aa, Artificial Sequence
  Description of Artificial Sequence: Synthetic peptide
EVQLQESGPGLLKPSETLSLTCTVSG

SEQ ID NO: 7204 - protein, 9 aa, Artificial Sequence
  Description of Artificial Sequence: Synthetic peptide
SPIASNYWS

SEQ ID NO: 7205 - protein, 14 aa, Artificial Sequence
  Description of Artificial Sequence: Synthetic peptide
WVRQPAGKGLEWIG

SEQ ID NO: 7206 - protein, 16 aa, Artificial Sequence
  Description of Artificial Sequence: Synthetic peptide
RIDTSPTTDYNPSLKS

SEQ ID NO: 7207 - protein, 30 aa, Artificial Sequence
  Description of Artificial Sequence: Synthetic polypeptide
RVIMSVDTSTSQFSLKMSSVTAADTAVYYC

SEQ ID NO: 7208 - protein, 21 aa, Artificial Sequence
  Description of Artificial Sequence: Synthetic peptide
TRSFISFDSSGHPYYYYAMDV

SEQ ID NO: 7209 - protein, 11 aa, Artificial Sequence
  Description of Artificial Sequence: Synthetic peptide
WGQGTTVTVSS

SEQ ID NO: 7210 - DNA, 381 bp, Artificial Sequence
  Description of Artificial Sequence: Synthetic polynucleotide
gaggtgcagctgcaggagtcgggcccaggactcttgaagccctcggagaccctgtccctcacctgcactgtctctggtagccccatcgctagtaattactggagctgggtccgacagcccgccgggaagggactggagtggattgggcgtattgacactagtccgaccaccgactacaacccctccctcaagagtcgcgtcatcatgtcagttgacacgtccacgagccagttctccctgaagatgagttctgtgaccgccgcggacacggccgtgtattactgtacgagaagttttatctcgtttgatagtagtggtcatccctactattactacgccatggacgtctggggccaagggaccacggtcaccgtctcctca

SEQ ID NO: 7211 - skipped

SEQ ID NO: 7212 - protein, 108 aa, Artificial Sequence
  Description of Artificial Sequence: Synthetic polypeptide
EIVMTQSPGTLSLSPGERVTLSCRATQSVSNNHLAWYQQKPGQAPRLLIYGASTTATDIPDRFSGRVAGTDFTLTISRLDPEDFAVYYCHQYGSSPWTFGQGTKVEIK

SEQ ID NO: 7213 - protein, 23 aa, Artificial Sequence
  Description of Artificial Sequence: Synthetic peptide
EIVMTQSPGTLSLSPGERVTLSC

SEQ ID NO: 7214 - protein, 12 aa, Artificial Sequence
  Description of Artificial Sequence: Synthetic peptide
RATQSVSNNHLA

SEQ ID NO: 7215 - protein, 15 aa, Artificial Sequence
  Description of Artificial Sequence: Synthetic peptide
WYQQKPGQAPRLLIY

SEQ ID NO: 7216 - protein, 7 aa, Artificial Sequence
  Description of Artificial Sequence: Synthetic peptide
GASTTAT

SEQ ID NO: 7217 - protein, 32 aa, Artificial Sequence
  Description of Artificial Sequence: Synthetic polypeptide
DIPDRFSGRVAGTDFTLTISRLDPEDFAVYYC

SEQ ID NO: 7218 - protein, 9 aa, Artificial Sequence
  Description of Artificial Sequence: Synthetic peptide
HQYGSSPWT

SEQ ID NO: 7219 - protein, 10 aa, Artificial Sequence
  Description of Artificial Sequence: Synthetic peptide
FGQGTKVEIK

SEQ ID NO: 7220 - DNA, 324 bp, Artificial Sequence
  Description of Artificial Sequence: Synthetic polynucleotide
gaaattgtgatgacgcagtctccaggcaccctgtctttgtctccaggggaaagagtcaccctctcctgcagggccactcagagtgttagcaacaaccacttagcctggtaccagcagaaacctggccaggctcccaggctcctcatctatggggcatccaccacggccactgacatcccagacaggttcagtggtcgggtggctgggaccgacttcactctcaccatcagcagactggaccctgaagattttgcagtgtattactgccaccagtatggttcctcaccgtggacgttcggccaagggaccaaggtggagatcaaa

SEQ ID NO: 7221-7301 - skipped (81 entries)

SEQ ID NO: 7302 - protein, 118 aa, Artificial Sequence
  Description of Artificial Sequence: Synthetic polypeptide
QVQLVQSGAEVRKPGSSVKLSCRASGGTFHTYTVNWVRQAPGQGLEWLGGIIPIFGTPTYAQRFQGKVSITADSSTNTVFMELTSLTSEDTAVYYCTRETGTDEFDFWGQGALVTVSS

SEQ ID NO: 7303 - protein, 26 aa, Artificial Sequence
  Description of Artificial Sequence: Synthetic peptide
QVQLVQSGAEVRKPGSSVKLSCRASG

SEQ ID NO: 7304 - protein, 9 aa, Artificial Sequence
  Description of Artificial Sequence: Synthetic peptide
GTFHTYTVN

SEQ ID NO: 7305 - protein, 14 aa, Artificial Sequence
  Description of Artificial Sequence: Synthetic peptide
WVRQAPGQGLEWLG

SEQ ID NO: 7306 - protein, 17 aa, Artificial Sequence
  Description of Artificial Sequence: Synthetic peptide
GIIPIFGTPTYAQRFQG

SEQ ID NO: 7307 - protein, 30 aa, Artificial Sequence
  Description of Artificial Sequence: Synthetic polypeptide
KVSITADSSTNTVFMELTSLTSEDTAVYYC

SEQ ID NO: 7308 - protein, 11 aa, Artificial Sequence
  Description of Artificial Sequence: Synthetic peptide
TRETGTDEFDF

SEQ ID NO: 7309 - protein, 11 aa, Artificial Sequence
  Description of Artificial Sequence: Synthetic peptide
WGQGALVTVSS

SEQ ID NO: 7310 - DNA, 354 bp, Artificial Sequence
  Description of Artificial Sequence: Synthetic polynucleotide
caggtccagctggtgcagtctggggctgaggtgaggaagcctgggtcctcggttaagctctcctgcagggcttctggaggcaccttccacacctatactgtcaactgggtgcgacaggcccctggacaagggcttgagtggttgggagggatcatccctatctttggtactccaacctatgcacagaggttccagggcaaagtctctattaccgcagactcatctacgaacacagtcttcatggaattgaccagcctcacatctgaggacacggccgtatattattgtacgagagaaactggaactgatgaatttgacttctggggccagggagccctggtcaccgtctcctca

SEQ ID NO: 7311 - skipped

SEQ ID NO: 7312 - protein, 109 aa, Artificial Sequence
  Description of Artificial Sequence: Synthetic polypeptide
DIRLTQSPATLSLSPGERATLSCRASQSVSSSLAWYQQKPGQAPRLLIYEASNRATGVPARFSGSGSGTDFTLAISSLEPEDFAVYYCQHRSNWPPRYTFGQGTKVEIK

SEQ ID NO: 7313 - protein, 23 aa, Artificial Sequence
  Description of Artificial Sequence: Synthetic peptide
DIRLTQSPATLSLSPGERATLSC

SEQ ID NO: 7314 - protein, 11 aa, Artificial Sequence
  Description of Artificial Sequence: Synthetic peptide
RASQSVSSSLA

SEQ ID NO: 7315 - protein, 15 aa, Artificial Sequence
  Description of Artificial Sequence: Synthetic peptide
WYQQKPGQAPRLLIY

SEQ ID NO: 7316 - protein, 7 aa, Artificial Sequence
  Description of Artificial Sequence: Synthetic peptide
EASNRAT

SEQ ID NO: 7317 - protein, 32 aa, Artificial Sequence
  Description of Artificial Sequence: Synthetic polypeptide
GVPARFSGSGSGTDFTLAISSLEPEDFAVYYC

SEQ ID NO: 7318 - protein, 11 aa, Artificial Sequence
  Description of Artificial Sequence: Synthetic peptide
QHRSNWPPRYT

SEQ ID NO: 7319 - protein, 10 aa, Artificial Sequence
  Description of Artificial Sequence: Synthetic peptide
FGQGTKVEIK

SEQ ID NO: 7320 - DNA, 327 bp, Artificial Sequence
  Description of Artificial Sequence: Synthetic polynucleotide
gacatccggttgacccagtctccagccaccctgtctttgtctcccggggagagagccaccctctcctgcagggccagtcagagtgttagcagctccttagcctggtatcaacagaaacctggccaggctcccagactcctcatctatgaggcatccaacagggccactggcgtcccagccaggttcagtggcagtgggtctgggacagacttcactctcgccatcagcagcctagagcctgaagattttgcagtttattactgtcagcaccgtagcaactggcctccgaggtacacttttggccaggggaccaaggtggaaatcaaa

SEQ ID NO: 7321-7401 - skipped (81 entries)

SEQ ID NO: 7402 - protein, 127 aa, Artificial Sequence
  Description of Artificial Sequence: Synthetic polypeptide
EVQLVESGPGLVKPSGTLSLTCAVSGASVSSDHWWSWVRQSPGKGLEWIGEVYHSGSTNYNPSLKSRVTISLDQSNNQFSLKLTSVTAADTAIYYCATMWGGLCTASNCYGNPMDVWGQGTTVTVSS

SEQ ID NO: 7403 - protein, 26 aa, Artificial Sequence
  Description of Artificial Sequence: Synthetic peptide
EVQLVESGPGLVKPSGTLSLTCAVSG

SEQ ID NO: 7404 - protein, 10 aa, Artificial Sequence
  Description of Artificial Sequence: Synthetic peptide
ASVSSDHWWS

SEQ ID NO: 7405 - protein, 14 aa, Artificial Sequence
  Description of Artificial Sequence: Synthetic peptide
WVRQSPGKGLEWIG

SEQ ID NO: 7406 - protein, 16 aa, Artificial Sequence
  Description of Artificial Sequence: Synthetic peptide
EVYHSGSTNYNPSLKS

SEQ ID NO: 7407 - protein, 30 aa, Artificial Sequence
  Description of Artificial Sequence: Synthetic polypeptide
RVTISLDQSNNQFSLKLTSVTAADTAIYYC

SEQ ID NO: 7408 - protein, 20 aa, Artificial Sequence
  Description of Artificial Sequence: Synthetic peptide
ATMWGGLCTASNCYGNPMDV

SEQ ID NO: 7409 - protein, 11 aa, Artificial Sequence
  Description of Artificial Sequence: Synthetic peptide
WGQGTTVTVSS

SEQ ID NO: 7410 - DNA, 381 bp, Artificial Sequence
  Description of Artificial Sequence: Synthetic polynucleotide
gaggtgcagctggtggagtctggcccaggactggtgaagccttcggggaccctgtccctcacctgcgctgtctccggtgcctccgtcagtagtgatcactggtggagttgggtccgccagtccccagggaagggcctggagtggattggcgaagtctatcatagtgggagcaccaactacaacccgtccctcaagagtcgagtcaccatatcactagaccagtccaataaccagttctccctgaagttgacctctgtgaccgccgcggacacggccatatattactgtgcgacaatgtggggcggactctgtactgctagcaactgctatggcaaccctatggacgtctggggccaagggaccacggtcaccgtctcctca

SEQ ID NO: 7411 - skipped

SEQ ID NO: 7412 - protein, 108 aa, Artificial Sequence
  Description of Artificial Sequence: Synthetic polypeptide
SYELTQPPSVSVSPGQTARITCSGDALPRRYAYWYQQRSGQAPVLVIYEDNKRPSGIPERFSAFSSGTRATLTISGAQVEDEADYYCYSTDSTANYKVFGGGTKVTVL

SEQ ID NO: 7413 - protein, 22 aa, Artificial Sequence
  Description of Artificial Sequence: Synthetic peptide
SYELTQPPSVSVSPGQTARITC

SEQ ID NO: 7414 - protein, 11 aa, Artificial Sequence
  Description of Artificial Sequence: Synthetic peptide
SGDALPRRYAY

SEQ ID NO: 7415 - protein, 15 aa, Artificial Sequence
  Description of Artificial Sequence: Synthetic peptide
WYQQRSGQAPVLVIY

SEQ ID NO: 7416 - protein, 7 aa, Artificial Sequence
  Description of Artificial Sequence: Synthetic peptide
EDNKRPS

SEQ ID NO: 7417 - protein, 32 aa, Artificial Sequence
  Description of Artificial Sequence: Synthetic polypeptide
GIPERFSAFSSGTRATLTISGAQVEDEADYYC

SEQ ID NO: 7418 - protein, 11 aa, Artificial Sequence
  Description of Artificial Sequence: Synthetic peptide
YSTDSTANYKV

SEQ ID NO: 7419 - protein, 10 aa, Artificial Sequence
  Description of Artificial Sequence: Synthetic peptide
FGGGTKVTVL

SEQ ID NO: 7420 - DNA, 324 bp, Artificial Sequence
  Description of Artificial Sequence: Synthetic polynucleotide
tcctatgagctgactcagccaccctcggtgtcagtgtccccaggacaaacggccaggatcacctgctctggagatgcattgcctagaagatatgcctattggtaccagcagaggtcaggccaggcccctgtgttggtcatctatgaagacaataaacgaccctccgggatccctgagagattctctgccttcagctcagggacaagggccaccttgactatcagtggggcccaggtagaggatgaagctgactactactgttactcaacagacagcactgccaattataaggtgtttggcggagggaccaaggtcaccgtccta

SEQ ID NO: 7421-7501 - skipped (81 entries)

SEQ ID NO: 7502 - protein, 127 aa, Artificial Sequence
  Description of Artificial Sequence: Synthetic polypeptide
EVQLVESGPGLVKPSGTLSLTCAVTGASVSSDHWWSWVRQSPGKGLEWIGEVYHSGSTNYNPSLKSRVTISLDQSNNQFSLKLTSVTAADTAIYYCATMWGGLCTASNCYGNPMDVWGQGTTVTVSS

SEQ ID NO: 7503 - protein, 26 aa, Artificial Sequence
  Description of Artificial Sequence: Synthetic peptide
EVQLVESGPGLVKPSGTLSLTCAVTG

SEQ ID NO: 7504 - protein, 10 aa, Artificial Sequence
  Description of Artificial Sequence: Synthetic peptide
ASVSSDHWWS

SEQ ID NO: 7505 - protein, 14 aa, Artificial Sequence
  Description of Artificial Sequence: Synthetic peptide
WVRQSPGKGLEWIG

SEQ ID NO: 7506 - protein, 16 aa, Artificial Sequence
  Description of Artificial Sequence: Synthetic peptide
EVYHSGSTNYNPSLKS

SEQ ID NO: 7507 - protein, 30 aa, Artificial Sequence; identical to SEQ ID NO: 7407
  Description of Artificial Sequence: Synthetic polypeptide

SEQ ID NO: 7508 - protein, 20 aa, Artificial Sequence
  Description of Artificial Sequence: Synthetic peptide
ATMWGGLCTASNCYGNPMDV

SEQ ID NO: 7509 - protein, 11 aa, Artificial Sequence
  Description of Artificial Sequence: Synthetic peptide
WGQGTTVTVSS

SEQ ID NO: 7510 - DNA, 381 bp, Artificial Sequence
  Description of Artificial Sequence: Synthetic polynucleotide
gaggtgcagctagtggagtcgggcccaggactggtgaagccttcggggaccctgtccctcacctgcgctgtcaccggtgcctccgtcagtagtgatcactggtggagttgggtccgccagtccccagggaagggcctggagtggattggcgaagtctaccatagtgggagcaccaactacaacccgtccctcaagagtcgagtcaccatatcactagaccagtccaataaccagttctccctgaagttgacctctgtgaccgccgcggacacggccatatattactgtgcgacaatgtggggcggactctgtactgctagcaactgctatggcaaccctatggacgtctggggccaagggaccacggtcactgtctcctca

SEQ ID NO: 7511 - skipped

SEQ ID NO: 7512 - protein, 108 aa, Artificial Sequence
  Description of Artificial Sequence: Synthetic polypeptide
SYELTQPPSVSVSPGQTARITCSGDALPRRYAYWYQQRSGQAPVLVIYEDNKRPSGIPERFSAFSSGTRATLTISGAQVEDEADYYCYSTDSTANYKVFGGGTKLTVL

SEQ ID NO: 7513 - protein, 22 aa, Artificial Sequence
  Description of Artificial Sequence: Synthetic peptide
SYELTQPPSVSVSPGQTARITC

SEQ ID NO: 7514 - protein, 11 aa, Artificial Sequence
  Description of Artificial Sequence: Synthetic peptide
SGDALPRRYAY

SEQ ID NO: 7515 - protein, 15 aa, Artificial Sequence
  Description of Artificial Sequence: Synthetic peptide
WYQQRSGQAPVLVIY

SEQ ID NO: 7516 - protein, 7 aa, Artificial Sequence
  Description of Artificial Sequence: Synthetic peptide
EDNKRPS

SEQ ID NO: 7517 - protein, 32 aa, Artificial Sequence; identical to SEQ ID NO: 7417
  Description of Artificial Sequence: Synthetic polypeptide

SEQ ID NO: 7518 - protein, 11 aa, Artificial Sequence
  Description of Artificial Sequence: Synthetic peptide
YSTDSTANYKV

SEQ ID NO: 7519 - protein, 10 aa, Artificial Sequence
  Description of Artificial Sequence: Synthetic peptide
FGGGTKLTVL

SEQ ID NO: 7520 - DNA, 324 bp, Artificial Sequence
  Description of Artificial Sequence: Synthetic polynucleotide
tcctatgagctgacacagccaccctcggtgtcagtgtccccaggacaaacggccaggatcacctgctctggagatgcattgcctagaagatatgcctattggtaccagcagaggtcaggccaggcccctgtgttggtcatctatgaagacaataaacgaccctccgggatccctgagagattctctgccttcagctcagggacaagggccaccttgactatcagtggggcccaggtagaggatgaagctgactactactgttactcaacagacagcactgccaattataaggtgtttggcggagggaccaagctgaccgtccta

SEQ ID NO: 7521-7601 - skipped (81 entries)

SEQ ID NO: 7602 - protein, 127 aa, Artificial Sequence
  Description of Artificial Sequence: Synthetic polypeptide
QVQLQESGPGLVKPSGTLSLTCAVSGASVSSDHWWSWVRQSPGKGLEWIGEVYHSGSTNYNPSLKSRVTISLDQSNNQFSLKLTSVTAADTAIYYCATMWGGLCTASNCYGNPMDVWGQGTTVTVSS

SEQ ID NO: 7603 - protein, 26 aa, Artificial Sequence
  Description of Artificial Sequence: Synthetic peptide
QVQLQESGPGLVKPSGTLSLTCAVSG

SEQ ID NO: 7604 - protein, 10 aa, Artificial Sequence
  Description of Artificial Sequence: Synthetic peptide
ASVSSDHWWS

SEQ ID NO: 7605 - protein, 14 aa, Artificial Sequence
  Description of Artificial Sequence: Synthetic peptide
WVRQSPGKGLEWIG

SEQ ID NO: 7606 - protein, 16 aa, Artificial Sequence
  Description of Artificial Sequence: Synthetic peptide
EVYHSGSTNYNPSLKS

SEQ ID NO: 7607 - protein, 30 aa, Artificial Sequence; identical to SEQ ID NO: 7407
  Description of Artificial Sequence: Synthetic polypeptide

SEQ ID NO: 7608 - protein, 20 aa, Artificial Sequence
  Description of Artificial Sequence: Synthetic peptide
ATMWGGLCTASNCYGNPMDV

SEQ ID NO: 7609 - protein, 11 aa, Artificial Sequence
  Description of Artificial Sequence: Synthetic peptide
WGQGTTVTVSS

SEQ ID NO: 7610 - DNA, 381 bp, Artificial Sequence
  Description of Artificial Sequence: Synthetic polynucleotide
caggtgcagctacaggagtcgggcccaggactggtgaagccttcggggaccctgtccctcacctgcgctgtctccggtgcctccgtcagtagtgatcactggtggagttgggtccgccagtccccagggaagggcctggagtggattggcgaagtctatcatagtgggagcaccaactacaacccgtccctcaagagtcgagtcaccatatcactagaccagtccaataaccagttctccctgaagttgacctctgtgaccgccgcggacacggccatatattactgtgcgacaatgtggggcggactctgtactgctagcaactgctatggcaaccctatggacgtctggggccaagggaccacggtcaccgtctcctca

SEQ ID NO: 7611 - skipped

SEQ ID NO: 7612 - protein, 108 aa, Artificial Sequence; identical to SEQ ID NO: 7512
  Description of Artificial Sequence: Synthetic polypeptide

SEQ ID NO: 7613 - protein, 22 aa, Artificial Sequence
  Description of Artificial Sequence: Synthetic peptide
SYELTQPPSVSVSPGQTARITC

SEQ ID NO: 7614 - protein, 11 aa, Artificial Sequence
  Description of Artificial Sequence: Synthetic peptide
SGDALPRRYAY

SEQ ID NO: 7615 - protein, 15 aa, Artificial Sequence
  Description of Artificial Sequence: Synthetic peptide
WYQQRSGQAPVLVIY

SEQ ID NO: 7616 - protein, 7 aa, Artificial Sequence
  Description of Artificial Sequence: Synthetic peptide
EDNKRPS

SEQ ID NO: 7617 - protein, 32 aa, Artificial Sequence; identical to SEQ ID NO: 7417
  Description of Artificial Sequence: Synthetic polypeptide

SEQ ID NO: 7618 - protein, 11 aa, Artificial Sequence
  Description of Artificial Sequence: Synthetic peptide
YSTDSTANYKV

SEQ ID NO: 7619 - protein, 10 aa, Artificial Sequence
  Description of Artificial Sequence: Synthetic peptide
FGGGTKLTVL

SEQ ID NO: 7620 - DNA, 324 bp, Artificial Sequence
  Description of Artificial Sequence: Synthetic polynucleotide
tcctatgagctgacgcagccaccctcggtgtcagtgtccccaggacaaacggccaggatcacctgctctggagatgcattgcctagaagatatgcctattggtaccagcagaggtcaggccaggcccctgtgttggtcatctatgaagacaataaacgaccctccgggatccctgagagattctctgccttcagctcagggacaagggccaccttgactatcagtggggcccaggtagaggatgaagctgactactactgttactcaacagacagcactgccaattataaggtgtttggcggagggaccaagctgaccgtccta

SEQ ID NO: 7621-7701 - skipped (81 entries)

SEQ ID NO: 7702 - protein, 118 aa, Artificial Sequence
  Description of Artificial Sequence: Synthetic polypeptide
QVQLQESGGGLVQPGGSLRLSCEASGFSFSDFVMHWVRQVPGKGLEWVSRISHDGSITSYVDSVKGRFTVSRDNGKKTLYLQMNSPRTEDTAVYYCARDLAWTFFDYWGHGTLVTVSS

SEQ ID NO: 7703 - protein, 26 aa, Artificial Sequence
  Description of Artificial Sequence: Synthetic peptide
QVQLQESGGGLVQPGGSLRLSCEASG

SEQ ID NO: 7704 - protein, 9 aa, Artificial Sequence
  Description of Artificial Sequence: Synthetic peptide
FSFSDFVMH

SEQ ID NO: 7705 - protein, 14 aa, Artificial Sequence
  Description of Artificial Sequence: Synthetic peptide
WVRQVPGKGLEWVS

SEQ ID NO: 7706 - protein, 17 aa, Artificial Sequence
  Description of Artificial Sequence: Synthetic peptide
RISHDGSITSYVDSVKG

SEQ ID NO: 7707 - protein, 30 aa, Artificial Sequence
  Description of Artificial Sequence: Synthetic polypeptide
RFTVSRDNGKKTLYLQMNSPRTEDTAVYYC

SEQ ID NO: 7708 - protein, 11 aa, Artificial Sequence
  Description of Artificial Sequence: Synthetic peptide
ARDLAWTFFDY

SEQ ID NO: 7709 - protein, 11 aa, Artificial Sequence
  Description of Artificial Sequence: Synthetic peptide
WGHGTLVTVSS

SEQ ID NO: 7710 - DNA, 354 bp, Artificial Sequence
  Description of Artificial Sequence: Synthetic polynucleotide
caggtgcagctgcaggagtccgggggaggcttagttcagccgggggggtccctgagactctcctgtgaagcctctggcttcagcttcagcgacttcgtcatgcactgggtccgccaagttccagggaaggggctggagtgggtctcacgtattagtcatgatgggagtatcacatcgtatgtggactccgtgaagggccgattcaccgtctcccgggacaatggcaagaagacattgtatctgcaaatgaacagtccgcgaaccgaggacacggctgtttattactgtgcgagagatttggcttggacattctttgactactggggccatggaaccctggtcaccgtctcttca

SEQ ID NO: 7711 - skipped

SEQ ID NO: 7712 - protein, 115 aa, Artificial Sequence
  Description of Artificial Sequence: Synthetic polypeptide
QSVLTQPSSLSASPGASASLTCTLHSGFNVGDHTINWYQQRPGSPPRYLLKYKSDSDKEQGSGVPIRFSGSKDASANAGFLLISGLRSEDEADYYCMIWHDNAVVFGGGTKLTVL

SEQ ID NO: 7713 - protein, 22 aa, Artificial Sequence
  Description of Artificial Sequence: Synthetic peptide
QSVLTQPSSLSASPGASASLTC

SEQ ID NO: 7714 - protein, 14 aa, Artificial Sequence
  Description of Artificial Sequence: Synthetic peptide
TLHSGFNVGDHTIN

SEQ ID NO: 7715 - protein, 15 aa, Artificial Sequence
  Description of Artificial Sequence: Synthetic peptide
WYQQRPGSPPRYLLK

SEQ ID NO: 7716 - protein, 11 aa, Artificial Sequence
  Description of Artificial Sequence: Synthetic peptide
YKSDSDKEQGS

SEQ ID NO: 7717 - protein, 34 aa, Artificial Sequence
  Description of Artificial Sequence: Synthetic polypeptide
GVPIRFSGSKDASANAGFLLISGLRSEDEADYYC

SEQ ID NO: 7718 - protein, 9 aa, Artificial Sequence
  Description of Artificial Sequence: Synthetic peptide
MIWHDNAVV

SEQ ID NO: 7719 - protein, 10 aa, Artificial Sequence
  Description of Artificial Sequence: Synthetic peptide
FGGGTKLTVL

SEQ ID NO: 7720 - DNA, 345 bp, Artificial Sequence
  Description of Artificial Sequence: Synthetic polynucleotide
cagtctgtcctgactcagccgtcttccctctctgcatctcctggagcgtcagccagtctcacctgcacattacacagcggcttcaatgttggtgaccacacgataaactggtaccaacagaggccagggagtcctccccggtatctcctgaaatacaaatcagactcagataaagaacagggctctggagtccccatccgcttctctggatccaaagacgcttcggccaacgcaggctttttactcatctctgggctccggtctgaggatgaggctgactattattgtatgatttggcacgacaacgctgttgtattcggcggcgggaccaagctgaccgtcctc

SEQ ID NO: 7721-7801 - skipped (81 entries)

SEQ ID NO: 7802 - protein, 115 aa, Artificial Sequence
  Description of Artificial Sequence: Synthetic polypeptide
EVQLLESGGGLVQPGGSLRLSCAASGFPFSTDAMNWVRQAPGEGLEWVSTISDTGRDTYYAASVKGRFTISRDNSKNTVYLQMNSLRAEDTAVYYCANTNFLDYWGQGTLVTVSS

SEQ ID NO: 7803 - protein, 26 aa, Artificial Sequence
  Description of Artificial Sequence: Synthetic peptide
EVQLLESGGGLVQPGGSLRLSCAASG

SEQ ID NO: 7804 - protein, 9 aa, Artificial Sequence
  Description of Artificial Sequence: Synthetic peptide
FPFSTDAMN

SEQ ID NO: 7805 - protein, 14 aa, Artificial Sequence
  Description of Artificial Sequence: Synthetic peptide
WVRQAPGEGLEWVS

SEQ ID NO: 7806 - protein, 17 aa, Artificial Sequence
  Description of Artificial Sequence: Synthetic peptide
TISDTGRDTYYAASVKG

SEQ ID NO: 7807 - protein, 30 aa, Artificial Sequence
  Description of Artificial Sequence: Synthetic polypeptide
RFTISRDNSKNTVYLQMNSLRAEDTAVYYC

SEQ ID NO: 7808 - protein, 8 aa, Artificial Sequence
  Description of Artificial Sequence: Synthetic peptide
ANTNFLDY

SEQ ID NO: 7809 - protein, 11 aa, Artificial Sequence
  Description of Artificial Sequence: Synthetic peptide
WGQGTLVTVSS

SEQ ID NO: 7810 - DNA, 345 bp, Artificial Sequence
  Description of Artificial Sequence: Synthetic polynucleotide
gaggtgcagctgttggagtctggggggggcttggtgcagccgggggggtccctgagactctcctgtgcagcctctggattcccctttagcaccgatgccatgaactgggtccgccaggctccaggggaggggctggagtgggtctcaactattagtgatactggtcgtgacacatactacgcagcctccgtgaagggccggttcaccatttccagagacaattccaagaacacagtttatctgcaaatgaacagcctgagagccgaggacacggccgtgtattactgtgcgaataccaacttccttgactactggggccagggaaccctggtcaccgtctcctca

SEQ ID NO: 7811 - skipped

SEQ ID NO: 7812 - protein, 112 aa, Artificial Sequence
  Description of Artificial Sequence: Synthetic polypeptide
EIVMTQSPLSLPVTLGQSASISCRSSQGLVHSDGNIYLNWFQQRPGQSPRRLIYKVSNRDSGVPDRFSGSGSGTDFTLKISRVEAEDVGLYYCMQATHWPRAFGQGTKVDIK

SEQ ID NO: 7813 - protein, 23 aa, Artificial Sequence
  Description of Artificial Sequence: Synthetic peptide
EIVMTQSPLSLPVTLGQSASISC

SEQ ID NO: 7814 - protein, 16 aa, Artificial Sequence
  Description of Artificial Sequence: Synthetic peptide
RSSQGLVHSDGNIYLN

SEQ ID NO: 7815 - protein, 15 aa, Artificial Sequence
  Description of Artificial Sequence: Synthetic peptide
WFQQRPGQSPRRLIY

SEQ ID NO: 7816 - protein, 7 aa, Artificial Sequence
  Description of Artificial Sequence: Synthetic peptide
KVSNRDS

SEQ ID NO: 7817 - protein, 32 aa, Artificial Sequence; identical to SEQ ID NO: 7017
  Description of Artificial Sequence: Synthetic polypeptide

SEQ ID NO: 7818 - protein, 9 aa, Artificial Sequence
  Description of Artificial Sequence: Synthetic peptide
MQATHWPRA

SEQ ID NO: 7819 - protein, 10 aa, Artificial Sequence
  Description of Artificial Sequence: Synthetic peptide
FGQGTKVDIK

SEQ ID NO: 7820 - DNA, 336 bp, Artificial Sequence
  Description of Artificial Sequence: Synthetic polynucleotide
gaaattgtgatgacacagtctccactctccctgcccgtcacccttggacagtcggcctccatctcctgcaggtctagtcaaggcctcgtacacagtgatggaaacatctatttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttgggctttattactgcatgcaagctacacactggcctcgagcgttcggccaagggaccaaagtggatatcaaa

SEQ ID NO: 7821-7901 - skipped (81 entries)

SEQ ID NO: 7902 - protein, 120 aa, Artificial Sequence
  Description of Artificial Sequence: Synthetic polypeptide
EVQLVESGGGLVQPGRSLRLSCAASGFILDDYAVHWVRLAPGKGLEWVSGITWNSGYLGYADSVKGRFTISRDNAKNSLYLQMNSLRPEDTALYYCAKLGTDHPIGVDVWGQGTTVTVSS

SEQ ID NO: 7903 - protein, 26 aa, Artificial Sequence
  Description of Artificial Sequence: Synthetic peptide
EVQLVESGGGLVQPGRSLRLSCAASG

SEQ ID NO: 7904 - protein, 9 aa, Artificial Sequence
  Description of Artificial Sequence: Synthetic peptide
FILDDYAVH

SEQ ID NO: 7905 - protein, 14 aa, Artificial Sequence
  Description of Artificial Sequence: Synthetic peptide
WVRLAPGKGLEWVS

SEQ ID NO: 7906 - protein, 17 aa, Artificial Sequence
  Description of Artificial Sequence: Synthetic peptide
GITWNSGYLGYADSVKG

SEQ ID NO: 7907 - protein, 30 aa, Artificial Sequence
  Description of Artificial Sequence: Synthetic polypeptide
RFTISRDNAKNSLYLQMNSLRPEDTALYYC

SEQ ID NO: 7908 - protein, 13 aa, Artificial Sequence
  Description of Artificial Sequence: Synthetic peptide
AKLGTDHPIGVDV

SEQ ID NO: 7909 - protein, 11 aa, Artificial Sequence
  Description of Artificial Sequence: Synthetic peptide
WGQGTTVTVSS

SEQ ID NO: 7910 - DNA, 360 bp, Artificial Sequence
  Description of Artificial Sequence: Synthetic polynucleotide
gaggtgcagctggtggaatctgggggaggcttggtacagcctggcaggtccctgaggctctcctgtgcagcctctggattcatccttgatgattatgccgtgcactgggtccggctagctccagggaagggcctggagtgggtctcaggtattacttggaatagtgggtacttaggctatgcggactctgtgaagggccgattcaccatctccagagacaacgccaagaactccctgtatctgcaaatgaatagtctgagacctgaggacacggccttgtattactgtgcaaagctcgggacggaccacccaataggtgtggacgtctggggccaagggaccacggtcactgtctcctca

SEQ ID NO: 7911 - skipped

SEQ ID NO: 7912 - protein, 112 aa, Artificial Sequence
  Description of Artificial Sequence: Synthetic polypeptide
DIVMTQSPLALSVTPGQPASISCKSSQSLLHSDGKTYFYWYLQKPGQSPHLLIYEVSNRFSGVPDRFSGSGSGTDFTLKISRVEAEDVGVYYCMQSIQVPITFGGGTKLEIK

SEQ ID NO: 7913 - protein, 23 aa, Artificial Sequence
  Description of Artificial Sequence: Synthetic peptide
DIVMTQSPLALSVTPGQPASISC

SEQ ID NO: 7914 - protein, 16 aa, Artificial Sequence
  Description of Artificial Sequence: Synthetic peptide
KSSQSLLHSDGKTYFY

SEQ ID NO: 7915 - protein, 15 aa, Artificial Sequence
  Description of Artificial Sequence: Synthetic peptide
WYLQKPGQSPHLLIY

SEQ ID NO: 7916 - protein, 7 aa, Artificial Sequence
  Description of Artificial Sequence: Synthetic peptide
EVSNRFS

SEQ ID NO: 7917 - protein, 32 aa, Artificial Sequence; identical to SEQ ID NO: 917
  Description of Artificial Sequence: Synthetic polypeptide

SEQ ID NO: 7918 - protein, 9 aa, Artificial Sequence
  Description of Artificial Sequence: Synthetic peptide
MQSIQVPIT

SEQ ID NO: 7919 - protein, 10 aa, Artificial Sequence
  Description of Artificial Sequence: Synthetic peptide
FGGGTKLEIK

SEQ ID NO: 7920 - DNA, 336 bp, Artificial Sequence
  Description of Artificial Sequence: Synthetic polynucleotide
gatattgtgatgactcagtctccactcgctctgtccgtcacccctggtcagccggcctccatctcctgcaagtctagtcagagcctcctgcatagtgatggaaagacctatttctattggtacctgcagaagccaggccagtctccacatctcctgatctatgaagtttccaaccggttctctggagtgccagataggttcagtggcagcgggtcagggacagatttcacactgaaaatcagccgggtggaggctgaggatgttggggtttattactgcatgcaaagtatacaggttccgatcactttcggcggagggaccaagctggagatcaaa

SEQ ID NO: 7921-8001 - skipped (81 entries)

SEQ ID NO: 8002 - protein, 121 aa, Artificial Sequence
  Description of Artificial Sequence: Synthetic polypeptide
QVQLVQSGGGLVQPGGSLRLSCSASGFTFNTYTMHWVRQAPGKGLEYVSAISSNGVVTYYADSVKGRFTISRDNSKNTLYLQMSSLRAEDTAVYYCVKALYSSSWCPFDYWGQGALVTVSS

SEQ ID NO: 8003 - protein, 26 aa, Artificial Sequence
  Description of Artificial Sequence: Synthetic peptide
QVQLVQSGGGLVQPGGSLRLSCSASG

SEQ ID NO: 8004 - protein, 9 aa, Artificial Sequence
  Description of Artificial Sequence: Synthetic peptide
FTFNTYTMH

SEQ ID NO: 8005 - protein, 14 aa, Artificial Sequence
  Description of Artificial Sequence: Synthetic peptide
WVRQAPGKGLEYVS

SEQ ID NO: 8006 - protein, 17 aa, Artificial Sequence
  Description of Artificial Sequence: Synthetic peptide
AISSNGVVTYYADSVKG

SEQ ID NO: 8007 - protein, 30 aa, Artificial Sequence
  Description of Artificial Sequence: Synthetic polypeptide
RFTISRDNSKNTLYLQMSSLRAEDTAVYYC

SEQ ID NO: 8008 - protein, 14 aa, Artificial Sequence
  Description of Artificial Sequence: Synthetic peptide
VKALYSSSWCPFDY

SEQ ID NO: 8009 - protein, 11 aa, Artificial Sequence
  Description of Artificial Sequence: Synthetic peptide
WGQGALVTVSS

SEQ ID NO: 8010 - DNA, 363 bp, Artificial Sequence
  Description of Artificial Sequence: Synthetic polynucleotide
caggtccagcttgtacagtctgggggaggcttggtccagcctggggggtccctgagactctcctgttcagcctctggattcaccttcaatacctatactatgcactgggtccgccaggctccagggaagggactggaatatgtttcagctattagtagtaatggggttgtcacatactacgcagactccgtgaagggcagatttaccatctccagagacaattccaagaacacgctgtatcttcaaatgagcagtctgagagctgaggacacggctgtgtattactgtgtgaaagccttgtatagcagcagctggtgcccctttgactactggggccagggagccctggtcaccgtctcctca

SEQ ID NO: 8011 - skipped

SEQ ID NO: 8012 - protein, 107 aa, Artificial Sequence
  Description of Artificial Sequence: Synthetic polypeptide
DIVMTQSPATLSVSPGERATLSCRASQSVSSNLAWYQQKPGQAPRLLIYGASTRATNIPARFSGSGSGTEFTLTISSLQSEDFAVYYCQQYNLWPYTFGQGTKVDIK

SEQ ID NO: 8013 - protein, 23 aa, Artificial Sequence
  Description of Artificial Sequence: Synthetic peptide
DIVMTQSPATLSVSPGERATLSC

SEQ ID NO: 8014 - protein, 11 aa, Artificial Sequence
  Description of Artificial Sequence: Synthetic peptide
RASQSVSSNLA

SEQ ID NO: 8015 - protein, 15 aa, Artificial Sequence
  Description of Artificial Sequence: Synthetic peptide
WYQQKPGQAPRLLIY

SEQ ID NO: 8016 - protein, 7 aa, Artificial Sequence
  Description of Artificial Sequence: Synthetic peptide
GASTRAT

SEQ ID NO: 8017 - protein, 32 aa, Artificial Sequence
  Description of Artificial Sequence: Synthetic polypeptide
NIPARFSGSGSGTEFTLTISSLQSEDFAVYYC

SEQ ID NO: 8018 - protein, 9 aa, Artificial Sequence
  Description of Artificial Sequence: Synthetic peptide
QQYNLWPYT

SEQ ID NO: 8019 - protein, 10 aa, Artificial Sequence
  Description of Artificial Sequence: Synthetic peptide
FGQGTKVDIK

SEQ ID NO: 8020 - DNA, 321 bp, Artificial Sequence
  Description of Artificial Sequence: Synthetic polynucleotide
gatattgtgatgacccagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactaatatcccagccaggttcagtggcagtgggtctgggacagagttcactctcaccatcagcagcctgcagtctgaagattttgcagtttattactgtcagcagtataatctctggccgtacacttttggccaggggaccaaagtggatatcaaa

SEQ ID NO: 8021-8101 - skipped (81 entries)

SEQ ID NO: 8102 - protein, 124 aa, Artificial Sequence
  Description of Artificial Sequence: Synthetic polypeptide
QVQLQQSGGGLVQPGGSLRLSCEASGFNFNSYSMSWVRQAPGKGLEWLSYISSRSSTIKYASSVQGRFTVSRDNAKKSVFLQMNSLRDEDTAVYYCARELDSETYYNYNSLDVWGQGTTVTVSS

SEQ ID NO: 8103 - protein, 26 aa, Artificial Sequence
  Description of Artificial Sequence: Synthetic peptide
QVQLQQSGGGLVQPGGSLRLSCEASG

SEQ ID NO: 8104 - protein, 9 aa, Artificial Sequence
  Description of Artificial Sequence: Synthetic peptide
FNFNSYSMS

SEQ ID NO: 8105 - protein, 14 aa, Artificial Sequence
  Description of Artificial Sequence: Synthetic peptide
WVRQAPGKGLEWLS

SEQ ID NO: 8106 - protein, 17 aa, Artificial Sequence
  Description of Artificial Sequence: Synthetic peptide
YISSRSSTIKYASSVQG

SEQ ID NO: 8107 - protein, 30 aa, Artificial Sequence
  Description of Artificial Sequence: Synthetic polypeptide
RFTVSRDNAKKSVFLQMNSLRDEDTAVYYC

SEQ ID NO: 8108 - protein, 17 aa, Artificial Sequence
  Description of Artificial Sequence: Synthetic peptide
ARELDSETYYNYNSLDV

SEQ ID NO: 8109 - protein, 11 aa, Artificial Sequence
  Description of Artificial Sequence: Synthetic peptide
WGQGTTVTVSS

SEQ ID NO: 8110 - DNA, 372 bp, Artificial Sequence
  Description of Artificial Sequence: Synthetic polynucleotide
caggtacagctgcagcagtctgggggaggcttggttcagccgggggggtccctgagactctcctgtgaagcctctggattcaacttcaatagttacagtatgagttgggtccgccaggctccagggaaggggctggagtggctttcatacattagtagccgtagttctactattaagtatgcaagctctgtgcagggccgcttcaccgtctcccgagacaatgcaaagaagtcagtgtttctgcaaatgaacagcctgagagacgaggacacggctgtctattactgtgcgagagaattggattctgagacttactacaattacaactctttggacgtctggggccagggcaccacggtcaccgtctcctca

SEQ ID NO: 8111 - skipped

SEQ ID NO: 8112 - protein, 107 aa, Artificial Sequence
  Description of Artificial Sequence: Synthetic polypeptide
EIVLTQSPSSLSASVGDRVTISCRASQGISTFLAWFQQRPGKAPKSLIYAASKLQSGVPSRFSGSDSGPDFTLTIDNLQPEDSATYYCKQYNSYPYTFGQGTKLEIK

SEQ ID NO: 8113 - protein, 23 aa, Artificial Sequence
  Description of Artificial Sequence: Synthetic peptide
EIVLTQSPSSLSASVGDRVTISC

SEQ ID NO: 8114 - protein, 11 aa, Artificial Sequence
  Description of Artificial Sequence: Synthetic peptide
RASQGISTFLA

SEQ ID NO: 8115 - protein, 15 aa, Artificial Sequence
  Description of Artificial Sequence: Synthetic peptide
WFQQRPGKAPKSLIY

SEQ ID NO: 8116 - protein, 7 aa, Artificial Sequence
  Description of Artificial Sequence: Synthetic peptide
AASKLQS

SEQ ID NO: 8117 - protein, 32 aa, Artificial Sequence
  Description of Artificial Sequence: Synthetic polypeptide
GVPSRFSGSDSGPDFTLTIDNLQPEDSATYYC

SEQ ID NO: 8118 - protein, 9 aa, Artificial Sequence
  Description of Artificial Sequence: Synthetic peptide
KQYNSYPYT

SEQ ID NO: 8119 - protein, 10 aa, Artificial Sequence
  Description of Artificial Sequence: Synthetic peptide
FGQGTKLEIK

SEQ ID NO: 8120 - DNA, 321 bp, Artificial Sequence
  Description of Artificial Sequence: Synthetic polynucleotide
gaaattgtgttgacgcagtctccatcctcactgtctgcatctgtgggagacagagtcaccatctcttgtcgggcgagtcagggcattagcacttttttagcctggtttcaacagagaccagggaaagcccctaagtccctgatctatgctgcatccaagttgcaaagtggggtcccatcaagattcagcggcagtgattctgggccagatttcactctcaccatcgacaacctgcagcctgaagattctgccacttattactgcaagcagtataatagttatccgtacacttttggccaggggaccaagctggagatcaaa

SEQ ID NO: 8121-8201 - skipped (81 entries)

SEQ ID NO: 8202 - protein, 123 aa, Artificial Sequence
  Description of Artificial Sequence: Synthetic polypeptide
QVQLQESGPGLVRPSETLSLTCTVSRGSISSSYWSWIRQPPGKGLEWIGFMYYSGSTNYNPSLKSRVTISLDTSKNQFSLKLSSVTAADTAVYYCAKAQGIYYRGWSYWFDPWGQGTLVTVSS

SEQ ID NO: 8203 - protein, 26 aa, Artificial Sequence
  Description of Artificial Sequence: Synthetic peptide
QVQLQESGPGLVRPSETLSLTCTVSR

SEQ ID NO: 8204 - protein, 9 aa, Artificial Sequence
  Description of Artificial Sequence: Synthetic peptide
GSISSSYWS

SEQ ID NO: 8205 - protein, 14 aa, Artificial Sequence
  Description of Artificial Sequence: Synthetic peptide
WIRQPPGKGLEWIG

SEQ ID NO: 8206 - protein, 16 aa, Artificial Sequence
  Description of Artificial Sequence: Synthetic peptide
FMYYSGSTNYNPSLKS

SEQ ID NO: 8207 - protein, 30 aa, Artificial Sequence
  Description of Artificial Sequence: Synthetic polypeptide
RVTISLDTSKNQFSLKLSSVTAADTAVYYC

SEQ ID NO: 8208 - protein, 17 aa, Artificial Sequence
  Description of Artificial Sequence: Synthetic peptide
AKAQGIYYRGWSYWFDP

SEQ ID NO: 8209 - protein, 11 aa, Artificial Sequence
  Description of Artificial Sequence: Synthetic peptide
WGQGTLVTVSS

SEQ ID NO: 8210 - DNA, 369 bp, Artificial Sequence
  Description of Artificial Sequence: Synthetic polynucleotide
caggtgcagctgcaggagtcgggcccaggactggtgaggccttcggagaccctgtccctcacctgcactgtctctcgtggctccatcagtagttcctactggagttggatccggcagcctccagggaagggactggagtggattggctttatgtattacagtgggagcaccaactacaacccctccctcaagagtcgagtcaccatatcactagacacgtccaagaatcagttctccctgaagttgagctctgtgaccgctgcggacacggccgtgtattactgtgcgaaagctcaggggatatattaccgtggctggtcctactggttcgacccctggggccagggaaccctggtcaccgtctcttca

SEQ ID NO: 8211 - skipped

SEQ ID NO: 8212 - protein, 110 aa, Artificial Sequence
  Description of Artificial Sequence: Synthetic polypeptide
QSVVTQPPSVSAAPGQKVTISCSGSSSNIGNNYVSWYQQLPGTAPKLLIYDSDKRPSGIPERFSGSKSATSATLGITGLQTGDEADYYCETWDDSLSAVVFGGGTKLTVL

SEQ ID NO: 8213 - protein, 22 aa, Artificial Sequence
  Description of Artificial Sequence: Synthetic peptide
QSVVTQPPSVSAAPGQKVTISC

SEQ ID NO: 8214 - protein, 13 aa, Artificial Sequence
  Description of Artificial Sequence: Synthetic peptide
SGSSSNIGNNYVS

SEQ ID NO: 8215 - protein, 15 aa, Artificial Sequence
  Description of Artificial Sequence: Synthetic peptide
WYQQLPGTAPKLLIY

SEQ ID NO: 8216 - protein, 7 aa, Artificial Sequence
  Description of Artificial Sequence: Synthetic peptide
DSDKRPS

SEQ ID NO: 8217 - protein, 32 aa, Artificial Sequence
  Description of Artificial Sequence: Synthetic polypeptide
GIPERFSGSKSATSATLGITGLQTGDEADYYC

SEQ ID NO: 8218 - protein, 11 aa, Artificial Sequence
  Description of Artificial Sequence: Synthetic peptide
ETWDDSLSAVV

SEQ ID NO: 8219 - protein, 10 aa, Artificial Sequence
  Description of Artificial Sequence: Synthetic peptide
FGGGTKLTVL

SEQ ID NO: 8220 - DNA, 330 bp, Artificial Sequence
  Description of Artificial Sequence: Synthetic polynucleotide
cagtctgtggtgacgcagccgccctcagtgtctgcggccccaggacagaaggtcaccatctcctgctctggaagcagctccaacattgggaataattatgtatcctggtaccagcagctcccaggaacagcccccaaactcctcatctatgacagtgataagcgaccctcagggattcctgagcgattctctggctccaagtctgccacgtcagccaccctgggcatcaccggactccagactggggacgaggccgattattactgcgaaacatgggatgacagcctgagtgccgtggtattcggcggagggaccaagctgaccgtcctc

SEQ ID NO: 8221-8301 - skipped (81 entries)

SEQ ID NO: 8302 - protein, 131 aa, Artificial Sequence
  Description of Artificial Sequence: Synthetic polypeptide
EVQLVQSGAEVKKPGASVKISCKASGYAFRNNYINWIRQAPGQGLEWMGIINPSAGTSTYAQKFQGRVTMTRDTSTNTVYMEITSLRSEDTATYFCAREARRQVTQWFGEFWGPYNWFDPWGQGTLVTVSS

SEQ ID NO: 8303 - protein, 26 aa, Artificial Sequence
  Description of Artificial Sequence: Synthetic peptide
EVQLVQSGAEVKKPGASVKISCKASG

SEQ ID NO: 8304 - protein, 9 aa, Artificial Sequence
  Description of Artificial Sequence: Synthetic peptide
YAFRNNYIN

SEQ ID NO: 8305 - protein, 14 aa, Artificial Sequence
  Description of Artificial Sequence: Synthetic peptide
WIRQAPGQGLEWMG

SEQ ID NO: 8306 - protein, 17 aa, Artificial Sequence
  Description of Artificial Sequence: Synthetic peptide
IINPSAGTSTYAQKFQG

SEQ ID NO: 8307 - protein, 30 aa, Artificial Sequence
  Description of Artificial Sequence: Synthetic polypeptide
RVTMTRDTSTNTVYMEITSLRSEDTATYFC

SEQ ID NO: 8308 - protein, 24 aa, Artificial Sequence
  Description of Artificial Sequence: Synthetic peptide
AREARRQVTQWFGEFWGPYNWFDP

SEQ ID NO: 8309 - protein, 11 aa, Artificial Sequence
  Description of Artificial Sequence: Synthetic peptide
WGQGTLVTVSS

SEQ ID NO: 8310 - DNA, 393 bp, Artificial Sequence
  Description of Artificial Sequence: Synthetic polynucleotide
gaggtgcagctggtgcagtctggggctgaggtgaagaagcctggggcctcagtgaagatttcctgcaaggcatctggatacgccttcaggaacaactatataaactggatacgacaggcccctggacaagggcttgagtggatgggaattatcaaccctagtgctggtacttcaacctacgcacagaaattccagggcagagtcaccatgaccagggacacgtccacgaatactgtctacatggaaattactagcctcagatctgaagacacggccacatatttctgtgcgagagaggcacggcgccaagtaacacaatggttcggggagttttggggtccctacaactggttcgacccctggggccagggaaccctggtcaccgtctcctca

SEQ ID NO: 8311 - skipped

SEQ ID NO: 8312 - protein, 112 aa, Artificial Sequence
  Description of Artificial Sequence: Synthetic polypeptide
DIVLTQSPLSLSVTPGQPASISCRSSQSLQHTDGKTYLYWYLQKPGQSPQLLIYELFNRFSGVPERFSGSGSGTDFTLKISRVEAEDVGIYYCMQSIQTPITFGQGTRLEIK

SEQ ID NO: 8313 - protein, 23 aa, Artificial Sequence
  Description of Artificial Sequence: Synthetic peptide
DIVLTQSPLSLSVTPGQPASISC

SEQ ID NO: 8314 - protein, 16 aa, Artificial Sequence
  Description of Artificial Sequence: Synthetic peptide
RSSQSLQHTDGKTYLY

SEQ ID NO: 8315 - protein, 15 aa, Artificial Sequence
  Description of Artificial Sequence: Synthetic peptide
WYLQKPGQSPQLLIY

SEQ ID NO: 8316 - protein, 7 aa, Artificial Sequence
  Description of Artificial Sequence: Synthetic peptide
ELFNRFS

SEQ ID NO: 8317 - protein, 32 aa, Artificial Sequence
  Description of Artificial Sequence: Synthetic polypeptide
GVPERFSGSGSGTDFTLKISRVEAEDVGIYYC

SEQ ID NO: 8318 - protein, 9 aa, Artificial Sequence
  Description of Artificial Sequence: Synthetic peptide
MQSIQTPIT

SEQ ID NO: 8319 - protein, 10 aa, Artificial Sequence
  Description of Artificial Sequence: Synthetic peptide
FGQGTRLEIK

SEQ ID NO: 8320 - DNA, 336 bp, Artificial Sequence
  Description of Artificial Sequence: Synthetic polynucleotide
gatattgtgctgactcagtctccactctctctgtccgtcaccccaggacagccggcctccatctcctgcaggtctagtcagagcctccaacatactgatggaaagacctatttgtattggtacctgcagaagccaggccagtctccacagctcctgatatatgaacttttcaaccggttctctggagtgccagagaggttcagtggcagcgggtcagggacagatttcacactgaagatcagccgggtggaggctgaggatgttggaatttattactgcatgcaaagtatacagactccgattaccttcggccaagggacacgactggagattaaa

SEQ ID NO: 8321-8401 - skipped (81 entries)

SEQ ID NO: 8402 - protein, 124 aa, Artificial Sequence
  Description of Artificial Sequence: Synthetic polypeptide
QVQLQQWGAGLLKPSETLSLTCGVYGVSFSDYYWSWIRQPPGKGLEWIGEINHSGITNYNPSLKSRVTISVDTSKNQFSLKLSSVTAADTAVYYCARGLISYTLWLRESYFDYWGQGTLVTVSS

SEQ ID NO: 8403 - protein, 26 aa, Artificial Sequence
  Description of Artificial Sequence: Synthetic peptide
QVQLQQWGAGLLKPSETLSLTCGVYG

SEQ ID NO: 8404 - protein, 9 aa, Artificial Sequence
  Description of Artificial Sequence: Synthetic peptide
VSFSDYYWS

SEQ ID NO: 8405 - protein, 14 aa, Artificial Sequence
  Description of Artificial Sequence: Synthetic peptide
WIRQPPGKGLEWIG

SEQ ID NO: 8406 - protein, 16 aa, Artificial Sequence
  Description of Artificial Sequence: Synthetic peptide
EINHSGITNYNPSLKS

SEQ ID NO: 8407 - protein, 30 aa, Artificial Sequence
  Description of Artificial Sequence: Synthetic polypeptide
RVTISVDTSKNQFSLKLSSVTAADTAVYYC

SEQ ID NO: 8408 - protein, 18 aa, Artificial Sequence
  Description of Artificial Sequence: Synthetic peptide
ARGLISYTLWLRESYFDY

SEQ ID NO: 8409 - protein, 11 aa, Artificial Sequence
  Description of Artificial Sequence: Synthetic peptide
WGQGTLVTVSS

SEQ ID NO: 8410 - DNA, 372 bp, Artificial Sequence
  Description of Artificial Sequence: Synthetic polynucleotide
caggtgcagctacagcagtggggcgcaggactgttgaagccttcggagaccctgtccctcacctgcggtgtctatggtgtgtccttcagtgattactactggagctggatccgccagcccccagggaaggggctggagtggattggggaaatcaatcatagtggaatcaccaactacaacccgtccctcaagagtcgagtcaccatatcagtagacacgtccaagaaccagttctccctgaagctgagttctgtgaccgccgcggacacggctgtgtattactgtgcgagaggccttatttcgtacacactatggctccgggagtcttactttgactactggggccagggaaccctggtcaccgtctcttca

SEQ ID NO: 8411 - skipped

SEQ ID NO: 8412 - protein, 113 aa, Artificial Sequence
  Description of Artificial Sequence: Synthetic polypeptide
DIRVTQSPDSLAVSLGERATINCKSSQSVLYSSNNKNYLAWYQQKIGQPPKLLIYWASIRESGVPDRFTGSGSGTDFTLTISSLQAEDVAVYYCQQYYSTPPTFGGGTKLEIK

SEQ ID NO: 8413 - protein, 23 aa, Artificial Sequence
  Description of Artificial Sequence: Synthetic peptide
DIRVTQSPDSLAVSLGERATINC

SEQ ID NO: 8414 - protein, 17 aa, Artificial Sequence
  Description of Artificial Sequence: Synthetic peptide
KSSQSVLYSSNNKNYLA

SEQ ID NO: 8415 - protein, 15 aa, Artificial Sequence
  Description of Artificial Sequence: Synthetic peptide
WYQQKIGQPPKLLIY

SEQ ID NO: 8416 - protein, 7 aa, Artificial Sequence
  Description of Artificial Sequence: Synthetic peptide
WASIRES

SEQ ID NO: 8417 - protein, 32 aa, Artificial Sequence
  Description of Artificial Sequence: Synthetic polypeptide
GVPDRFTGSGSGTDFTLTISSLQAEDVAVYYC

SEQ ID NO: 8418 - protein, 9 aa, Artificial Sequence
  Description of Artificial Sequence: Synthetic peptide
QQYYSTPPT

SEQ ID NO: 8419 - protein, 10 aa, Artificial Sequence
  Description of Artificial Sequence: Synthetic peptide
FGGGTKLEIK

SEQ ID NO: 8420 - DNA, 339 bp, Artificial Sequence
  Description of Artificial Sequence: Synthetic polynucleotide
gacatccgggtgacccagtctccagactccctggctgtgtctctgggcgagagggccaccatcaactgcaagtccagccagagtgttctatacagctccaacaataagaactacttagcttggtaccagcagaaaataggacagcctcctaagctgctcatttactgggcatctattcgggaatccggggtccctgaccgattcactggcagcgggtctgggacagatttcactctcaccatcagcagcctgcaggctgaagatgtggcagtttattactgtcagcaatattatagtactcctcccactttcggcggagggaccaagctggagatcaaa

SEQ ID NO: 8421-8501 - skipped (81 entries)

SEQ ID NO: 8502 - protein, 126 aa, Artificial Sequence
  Description of Artificial Sequence: Synthetic polypeptide
QVQLVQSGAEVKKPGSSVKVSCKASGGSLRDYAISWVRQAPGQGPEWMGGIMPIFGTAGYAQKFQGRVKFTADESATTAYMELTGLRSEDSAVYFCARDPSILNTGNHHWYDLDIWGQGTTVTVSS

SEQ ID NO: 8503 - protein, 26 aa, Artificial Sequence
  Description of Artificial Sequence: Synthetic peptide
QVQLVQSGAEVKKPGSSVKVSCKASG

SEQ ID NO: 8504 - protein, 9 aa, Artificial Sequence
  Description of Artificial Sequence: Synthetic peptide
GSLRDYAIS

SEQ ID NO: 8505 - protein, 14 aa, Artificial Sequence
  Description of Artificial Sequence: Synthetic peptide
WVRQAPGQGPEWMG

SEQ ID NO: 8506 - protein, 17 aa, Artificial Sequence
  Description of Artificial Sequence: Synthetic peptide
GIMPIFGTAGYAQKFQG

SEQ ID NO: 8507 - protein, 30 aa, Artificial Sequence
  Description of Artificial Sequence: Synthetic polypeptide
RVKFTADESATTAYMELTGLRSEDSAVYFC

SEQ ID NO: 8508 - protein, 19 aa, Artificial Sequence
  Description of Artificial Sequence: Synthetic peptide
ARDPSILNTGNHHWYDLDI

SEQ ID NO: 8509 - protein, 11 aa, Artificial Sequence
  Description of Artificial Sequence: Synthetic peptide
WGQGTTVTVSS

SEQ ID NO: 8510 - DNA, 378 bp, Artificial Sequence
  Description of Artificial Sequence: Synthetic polynucleotide
caggtgcagctggtgcagtctggggctgaagtgaagaagcctgggtcctcggtgaaggtctcctgcaaggcttctggaggctccctcagagattatgccatcagctgggtgcgacaggcccctggacaaggccctgagtggatgggggggatcatgcccatctttggaacggcaggctacgcacagaagtttcagggcagagtcaaattcaccgcggacgaatccgcgaccacagcctacatggagttgaccggcctcagatctgaagactcggccgtgtatttctgtgcgagagacccctctattctaaatactgggaatcaccactggtatgatttagatatttggggccaagggaccacggtcaccgtctcctca

SEQ ID NO: 8511 - skipped

SEQ ID NO: 8512 - protein, 112 aa, Artificial Sequence
  Description of Artificial Sequence: Synthetic polypeptide
EIVMTQTPLSLPVTLGQPASISCRSSQFVSHTDGNTYLNWFQQRPGQSPRRLIYKVSKRDSGVPDRFSGSGSGTDFTLTISRVEAEDVGVYYCMQATEWPRTFGQGTKVEYQ

SEQ ID NO: 8513 - protein, 23 aa, Artificial Sequence
  Description of Artificial Sequence: Synthetic peptide
EIVMTQTPLSLPVTLGQPASISC

SEQ ID NO: 8514 - protein, 16 aa, Artificial Sequence
  Description of Artificial Sequence: Synthetic peptide
RSSQFVSHTDGNTYLN

SEQ ID NO: 8515 - protein, 15 aa, Artificial Sequence
  Description of Artificial Sequence: Synthetic peptide
WFQQRPGQSPRRLIY

SEQ ID NO: 8516 - protein, 7 aa, Artificial Sequence
  Description of Artificial Sequence: Synthetic peptide
KVSKRDS

SEQ ID NO: 8517 - protein, 32 aa, Artificial Sequence
  Description of Artificial Sequence: Synthetic polypeptide
GVPDRFSGSGSGTDFTLTISRVEAEDVGVYYC

SEQ ID NO: 8518 - protein, 9 aa, Artificial Sequence
  Description of Artificial Sequence: Synthetic peptide
MQATEWPRT

SEQ ID NO: 8519 - protein, 10 aa, Artificial Sequence
  Description of Artificial Sequence: Synthetic peptide
FGQGTKVEYQ

SEQ ID NO: 8520 - DNA, 336 bp, Artificial Sequence
  Description of Artificial Sequence: Synthetic polynucleotide
gaaattgtgatgacgcagactccactctccctgcccgtcacccttggacagccggcctccatctcctgcaggtctagtcagttcgtcagccatactgatggaaacacctacttgaattggtttcagcagaggccaggccaatctccaaggcgcctaatttataaggtttctaagcgggactccggggtcccagacagattcagcggcagtgggtcaggcactgatttcacattgacaatcagtagggtggaggctgaggatgttggggtttattactgcatgcaagcaacagagtggcctcggacgttcggccaagggaccaaagtggagtatcaa

SEQ ID NO: 8521-8601 - skipped (81 entries)

SEQ ID NO: 8602 - protein, 118 aa, Artificial Sequence
  Description of Artificial Sequence: Synthetic polypeptide
QVQLVQSGAEVKKPGASVKVSCKASGYTFTNDGFVWVRQAPGQVPEWMGWISVHTGDTIYAQRFQGRVTMTTDTSTRTSYMELMSLRSDDTAVYYCARDYGDGPPDHWGQGTLVTVSS

SEQ ID NO: 8603 - protein, 26 aa, Artificial Sequence
  Description of Artificial Sequence: Synthetic peptide
QVQLVQSGAEVKKPGASVKVSCKASG

SEQ ID NO: 8604 - protein, 9 aa, Artificial Sequence
  Description of Artificial Sequence: Synthetic peptide
YTFTNDGFV

SEQ ID NO: 8605 - protein, 14 aa, Artificial Sequence
  Description of Artificial Sequence: Synthetic peptide
WVRQAPGQVPEWMG

SEQ ID NO: 8606 - protein, 17 aa, Artificial Sequence
  Description of Artificial Sequence: Synthetic peptide
WISVHTGDTIYAQRFQG

SEQ ID NO: 8607 - protein, 30 aa, Artificial Sequence
  Description of Artificial Sequence: Synthetic polypeptide
RVTMTTDTSTRTSYMELMSLRSDDTAVYYC

SEQ ID NO: 8608 - protein, 11 aa, Artificial Sequence
  Description of Artificial Sequence: Synthetic peptide
ARDYGDGPPDH

SEQ ID NO: 8609 - protein, 11 aa, Artificial Sequence
  Description of Artificial Sequence: Synthetic peptide
WGQGTLVTVSS

SEQ ID NO: 8610 - DNA, 354 bp, Artificial Sequence
  Description of Artificial Sequence: Synthetic polynucleotide
caggtccagctggtgcagtctggagctgaggtgaagaagcctggggcctcagtgaaggtctcctgcaaggcttctggttacacctttactaacgacggtttcgtctgggtgcgacaggcccctggacaggtgcctgagtggatgggatggatcagcgttcacaccggtgacacaatttatgcacagagattccagggccgagtcaccatgaccacagacacatccacgagaacatcctacatggaactgatgagcctgcgatctgacgacacggccgtctattactgtgcgagagattatggcgatgggccccctgaccactggggccagggaaccctggtcaccgtctcctca

SEQ ID NO: 8611 - skipped

SEQ ID NO: 8612 - protein, 114 aa, Artificial Sequence
  Description of Artificial Sequence: Synthetic polypeptide
DIVMTQSPDSLAVSLGERATINCKSSQSVLFSSNNKNYLAWYQQKPGLPPKLLIYWASTRKSGVSDRFSGSGSGTDFTLTISSLQAEDVAVYYCQQYYTTPLFTFGPGTKVDIK

SEQ ID NO: 8613 - protein, 23 aa, Artificial Sequence
  Description of Artificial Sequence: Synthetic peptide
DIVMTQSPDSLAVSLGERATINC

SEQ ID NO: 8614 - protein, 17 aa, Artificial Sequence
  Description of Artificial Sequence: Synthetic peptide
KSSQSVLFSSNNKNYLA

SEQ ID NO: 8615 - protein, 15 aa, Artificial Sequence
  Description of Artificial Sequence: Synthetic peptide
WYQQKPGLPPKLLIY

SEQ ID NO: 8616 - protein, 7 aa, Artificial Sequence
  Description of Artificial Sequence: Synthetic peptide
WASTRKS

SEQ ID NO: 8617 - protein, 32 aa, Artificial Sequence
  Description of Artificial Sequence: Synthetic polypeptide
GVSDRFSGSGSGTDFTLTISSLQAEDVAVYYC

SEQ ID NO: 8618 - protein, 10 aa, Artificial Sequence
  Description of Artificial Sequence: Synthetic peptide
QQYYTTPLFT

SEQ ID NO: 8619 - protein, 10 aa, Artificial Sequence
  Description of Artificial Sequence: Synthetic peptide
FGPGTKVDIK

SEQ ID NO: 8620 - DNA, 342 bp, Artificial Sequence
  Description of Artificial Sequence: Synthetic polynucleotide
gatattgtgatgacccagtctccggactccctggctgtgtctctgggcgagagggccaccatcaactgcaagtccagccagagtgttttattcagttccaacaataagaactacttagcttggtaccagcagaaaccagggctgcctcctaagctgctcatttactgggcatctacccggaaatccggggtctctgaccgattcagtggcagcgggtctgggacagatttcactctcaccatcagcagcctgcaggctgaagatgtggcagtttattactgtcagcagtattatactactcccttatttactttcggccctgggaccaaagtggatatcaaa

SEQ ID NO: 8621-8701 - skipped (81 entries)

SEQ ID NO: 8702 - protein, 124 aa, Artificial Sequence
  Description of Artificial Sequence: Synthetic polypeptide
QVQLVQSGPEVKKPGSSVRVSCKVSGGPFSSYGVSWARQAPEKGLEWMGGVLPIFGTVGYVHKFQGRVTITADESTSTVYMALSSLRSEDTAVYYCVLDTTMSHPHNWYGMDVWGHGTTVTVSS

SEQ ID NO: 8703 - protein, 26 aa, Artificial Sequence
  Description of Artificial Sequence: Synthetic peptide
QVQLVQSGPEVKKPGSSVRVSCKVSG

SEQ ID NO: 8704 - protein, 9 aa, Artificial Sequence
  Description of Artificial Sequence: Synthetic peptide
GPFSSYGVS

SEQ ID NO: 8705 - protein, 14 aa, Artificial Sequence
  Description of Artificial Sequence: Synthetic peptide
WARQAPEKGLEWMG

SEQ ID NO: 8706 - protein, 17 aa, Artificial Sequence
  Description of Artificial Sequence: Synthetic peptide
GVLPIFGTVGYVHKFQG

SEQ ID NO: 8707 - protein, 30 aa, Artificial Sequence
  Description of Artificial Sequence: Synthetic polypeptide
RVTITADESTSTVYMALSSLRSEDTAVYYC

SEQ ID NO: 8708 - protein, 17 aa, Artificial Sequence
  Description of Artificial Sequence: Synthetic peptide
VLDTTMSHPHNWYGMDV

SEQ ID NO: 8709 - protein, 11 aa, Artificial Sequence
  Description of Artificial Sequence: Synthetic peptide
WGHGTTVTVSS

SEQ ID NO: 8710 - DNA, 372 bp, Artificial Sequence
  Description of Artificial Sequence: Synthetic polynucleotide
caggtccagctggtgcagtctgggcctgaggtgaagaagcccgggtcctcggtgagagtctcctgtaaggtttctggaggccccttcagcagttatggtgtcagctgggcgcgacaggcccctgaaaaagggcttgaatggatgggaggagtcctccctatctttggaacagtaggttatgttcacaagttccagggcagagtcaccattaccgcggacgaatccacgagcacagtttacatggcactgagcagcctgagatctgaagacacggccgtctattactgtgtcttagatacaacaatgtcacacccgcacaattggtacggtatggacgtctggggccacgggaccacggtcaccgtctcctca

SEQ ID NO: 8711 - skipped

SEQ ID NO: 8712 - protein, 112 aa, Artificial Sequence
  Description of Artificial Sequence: Synthetic polypeptide
DIVMTQSPLSLPVTLGQPASISCRSSHSLVHTNGNTYLNWFQQRPGQPPRRLIYQVSNRDSGVPDRFSGSGSGTDFTLKISRVEADDVGIYYCMQGTDWPRTFGQGTKVDIK

SEQ ID NO: 8713 - protein, 23 aa, Artificial Sequence
  Description of Artificial Sequence: Synthetic peptide
DIVMTQSPLSLPVTLGQPASISC

SEQ ID NO: 8714 - protein, 16 aa, Artificial Sequence
  Description of Artificial Sequence: Synthetic peptide
RSSHSLVHTNGNTYLN

SEQ ID NO: 8715 - protein, 15 aa, Artificial Sequence
  Description of Artificial Sequence: Synthetic peptide
WFQQRPGQPPRRLIY

SEQ ID NO: 8716 - protein, 7 aa, Artificial Sequence
  Description of Artificial Sequence: Synthetic peptide
QVSNRDS

SEQ ID NO: 8717 - protein, 32 aa, Artificial Sequence
  Description of Artificial Sequence: Synthetic polypeptide
GVPDRFSGSGSGTDFTLKISRVEADDVGIYYC

SEQ ID NO: 8718 - protein, 9 aa, Artificial Sequence
  Description of Artificial Sequence: Synthetic peptide
MQGTDWPRT

SEQ ID NO: 8719 - protein, 10 aa, Artificial Sequence
  Description of Artificial Sequence: Synthetic peptide
FGQGTKVDIK

SEQ ID NO: 8720 - DNA, 336 bp, Artificial Sequence
  Description of Artificial Sequence: Synthetic polynucleotide
gatattgtgatgacccagtctccactctccctgcccgtcacccttggacagccggcctccatctcctgcaggtctagtcacagcctcgtacacactaatggaaacacctacttgaattggtttcaacagaggccaggccagcctccaaggcgcctaatttatcaggtttccaaccgggactctggggtcccagacagattcagcggcagtgggtcaggcactgatttcacactgaaaatcagcagggtggaggctgacgatgttgggatttattactgcatgcagggtacagactggcctcggacgttcggccaagggaccaaagtggatatcaaa

SEQ ID NO: 8721-8801 - skipped (81 entries)

SEQ ID NO: 8802 - protein, 126 aa, Artificial Sequence
  Description of Artificial Sequence: Synthetic polypeptide
QVQLVQSGAEVKKPGSSVKVSCKASGGTLSDYAISWVRQAPGQGLEWMGGIMPVFGSPGYAEIFQGRLTITADESRSTAYMELTSLRSEDTAVYYCARDPSILNTGPHHWYDLDIWGPGTTVTVSS

SEQ ID NO: 8803 - protein, 26 aa, Artificial Sequence
  Description of Artificial Sequence: Synthetic peptide
QVQLVQSGAEVKKPGSSVKVSCKASG

SEQ ID NO: 8804 - protein, 9 aa, Artificial Sequence
  Description of Artificial Sequence: Synthetic peptide
GTLSDYAIS

SEQ ID NO: 8805 - protein, 14 aa, Artificial Sequence
  Description of Artificial Sequence: Synthetic peptide
WVRQAPGQGLEWMG

SEQ ID NO: 8806 - protein, 17 aa, Artificial Sequence
  Description of Artificial Sequence: Synthetic peptide
GIMPVFGSPGYAEIFQG

SEQ ID NO: 8807 - protein, 30 aa, Artificial Sequence
  Description of Artificial Sequence: Synthetic polypeptide
RLTITADESRSTAYMELTSLRSEDTAVYYC

SEQ ID NO: 8808 - protein, 19 aa, Artificial Sequence
  Description of Artificial Sequence: Synthetic peptide
ARDPSILNTGPHHWYDLDI

SEQ ID NO: 8809 - protein, 11 aa, Artificial Sequence
  Description of Artificial Sequence: Synthetic peptide
WGPGTTVTVSS

SEQ ID NO: 8810 - DNA, 378 bp, Artificial Sequence
  Description of Artificial Sequence: Synthetic polynucleotide
caggtccagctggtgcagtctggggctgaggtgaagaagcctgggtcctcagtgaaggtctcctgcaaggcttctggaggcaccctcagtgattacgccatcagctgggtgcgacaggcccctggacaagggcttgagtggatgggagggatcatgcctgtctttggttcgccaggctacgcagaaattttccagggcagactcacgattaccgcggacgaatccaggagcacagcctacatggaactgaccagcctgaggtctgaggacacggccgtgtattactgtgcgagagatccgtctattcttaatactgggcctcaccactggtatgatttagatatctggggcccagggaccacggtcaccgtctcttca

SEQ ID NO: 8811 - skipped

SEQ ID NO: 8812 - protein, 112 aa, Artificial Sequence
  Description of Artificial Sequence: Synthetic polypeptide
DIVMTQSPLSLPVSLGQPASISCRSSQSVVHTDGNTYLNWYQQRPGQSPRRLIYKVSNRDSGVPDRFSGSGSVTDFTLKISRVEAEDVAVYYCMQGTEWPRTFGQGTKVDIK

SEQ ID NO: 8813 - protein, 23 aa, Artificial Sequence
  Description of Artificial Sequence: Synthetic peptide
DIVMTQSPLSLPVSLGQPASISC

SEQ ID NO: 8814 - protein, 16 aa, Artificial Sequence
  Description of Artificial Sequence: Synthetic peptide
RSSQSVVHTDGNTYLN

SEQ ID NO: 8815 - protein, 15 aa, Artificial Sequence
  Description of Artificial Sequence: Synthetic peptide
WYQQRPGQSPRRLIY

SEQ ID NO: 8816 - protein, 7 aa, Artificial Sequence
  Description of Artificial Sequence: Synthetic peptide
KVSNRDS

SEQ ID NO: 8817 - protein, 32 aa, Artificial Sequence
  Description of Artificial Sequence: Synthetic polypeptide
GVPDRFSGSGSVTDFTLKISRVEAEDVAVYYC

SEQ ID NO: 8818 - protein, 9 aa, Artificial Sequence
  Description of Artificial Sequence: Synthetic peptide
MQGTEWPRT

SEQ ID NO: 8819 - protein, 10 aa, Artificial Sequence
  Description of Artificial Sequence: Synthetic peptide
FGQGTKVDIK

SEQ ID NO: 8820 - DNA, 336 bp, Artificial Sequence
  Description of Artificial Sequence: Synthetic polynucleotide
gatattgtgatgactcagtctccactctccctgcccgtcagcctcggacagccggcctccatctcctgcaggtctagtcaaagcgtcgtacacactgatgggaacacctacttgaattggtatcagcagaggccaggccaatctccaaggcgcctaatttataaggtttctaaccgggactccggggtcccagacagattcagcggcagtgggtcagtcactgatttcacactgaaaatcagcagggtggaggctgaggatgttgccgtttattactgcatgcaaggtacagagtggcctcggacgttcggccaagggaccaaagtggatatcaaa

SEQ ID NO: 8821-8901 - skipped (81 entries)

SEQ ID NO: 8902 - protein, 129 aa, Artificial Sequence
  Description of Artificial Sequence: Synthetic polypeptide
EVQLVQSGAEVKKPGSSMRVSCRVSGGTFITHAMSWVRQAPGQGPEWMGGIVPLFGRASYAQPSQTRVQITADESTSTVYLEVPSLTSEDTAVYYCVRDSEPYTATRSQNHYWYDMDVWGQGTTVTVSS

SEQ ID NO: 8903 - protein, 26 aa, Artificial Sequence
  Description of Artificial Sequence: Synthetic peptide
EVQLVQSGAEVKKPGSSMRVSCRVSG

SEQ ID NO: 8904 - protein, 9 aa, Artificial Sequence
  Description of Artificial Sequence: Synthetic peptide
GTFITHAMS

SEQ ID NO: 8905 - protein, 14 aa, Artificial Sequence
  Description of Artificial Sequence: Synthetic peptide
WVRQAPGQGPEWMG

SEQ ID NO: 8906 - protein, 17 aa, Artificial Sequence
  Description of Artificial Sequence: Synthetic peptide
GIVPLFGRASYAQPSQT

SEQ ID NO: 8907 - protein, 30 aa, Artificial Sequence
  Description of Artificial Sequence: Synthetic polypeptide
RVQITADESTSTVYLEVPSLTSEDTAVYYC

SEQ ID NO: 8908 - protein, 22 aa, Artificial Sequence
  Description of Artificial Sequence: Synthetic peptide
VRDSEPYTATRSQNHYWYDMDV

SEQ ID NO: 8909 - protein, 11 aa, Artificial Sequence
  Description of Artificial Sequence: Synthetic peptide
WGQGTTVTVSS

SEQ ID NO: 8910 - DNA, 387 bp, Artificial Sequence
  Description of Artificial Sequence: Synthetic polynucleotide
gaggtgcagctggtacagtctggggctgaagtgaagaagcctgggtcctcgatgagggtctcctgtagggtttctggaggcaccttcatcacccatgctatgagttgggtgcgacaggcccctggacaagggccggagtggatgggagggatcgtccctctttttgggagagcgagctacgcacagccgtcgcagaccagagtccaaattactgcggacgaaagtacgagtacagtgtatctggaagtgcccagcctgacatctgaggacacggccgtctattactgtgtgagagattctgagccctacacggcgacgaggagtcaaaatcattattggtatgatatggacgtctggggccaagggaccacggtcaccgtctcctca

SEQ ID NO: 8911 - skipped

SEQ ID NO: 8912 - protein, 113 aa, Artificial Sequence
  Description of Artificial Sequence: Synthetic polypeptide
DIQMTQSPLSLSVTLGQSASISCRASQTVVHSVDGNTYLNWFHQRPGQSPRRLIYKVSNRDSGVPDRFSGSGSGTDFTLRISRVEAEDIGIYYCMQGTDWPRTFGQGTKVEIK

SEQ ID NO: 8913 - protein, 23 aa, Artificial Sequence
  Description of Artificial Sequence: Synthetic peptide
DIQMTQSPLSLSVTLGQSASISC

SEQ ID NO: 8914 - protein, 17 aa, Artificial Sequence
  Description of Artificial Sequence: Synthetic peptide
RASQTVVHSVDGNTYLN

SEQ ID NO: 8915 - protein, 15 aa, Artificial Sequence
  Description of Artificial Sequence: Synthetic peptide
WFHQRPGQSPRRLIY

SEQ ID NO: 8916 - protein, 7 aa, Artificial Sequence
  Description of Artificial Sequence: Synthetic peptide
KVSNRDS

SEQ ID NO: 8917 - protein, 32 aa, Artificial Sequence
  Description of Artificial Sequence: Synthetic polypeptide
GVPDRFSGSGSGTDFTLRISRVEAEDIGIYYC

SEQ ID NO: 8918 - protein, 9 aa, Artificial Sequence
  Description of Artificial Sequence: Synthetic peptide
MQGTDWPRT

SEQ ID NO: 8919 - protein, 10 aa, Artificial Sequence
  Description of Artificial Sequence: Synthetic peptide
FGQGTKVEIK

SEQ ID NO: 8920 - DNA, 339 bp, Artificial Sequence
  Description of Artificial Sequence: Synthetic polynucleotide
gacatccagatgacccagtctccactctccctgtccgtcacccttggacagtcggcctccatctcctgcagggctagtcaaaccgtcgtacacagtgttgatggaaacacgtacttgaattggtttcaccagaggccaggccaatctccaaggcgcctaatttataaggtttctaatcgggactctggggtcccagacagattcagcggcagtgggtcaggcactgacttcacactgaggatcagcagagtggaggctgaagatattgggatttattattgcatgcaaggtacagactggcctcggacctttggccaggggaccaaggtggagatcaaa

SEQ ID NO: 8921-9001 - skipped (81 entries)

SEQ ID NO: 9002 - protein, 125 aa, Artificial Sequence
  Description of Artificial Sequence: Synthetic polypeptide
EVQLVESGPGLVKPSATLSLTCTVSGGSINNYYWTWVRQSAGKGLEWIGRINTSGSTNYNASLKSRVTMSIDTSKNEFSLRLSSVTAADTAVYYCAREFGVRFLDRSLFGAMDVWGHGATVTVSS

SEQ ID NO: 9003 - protein, 26 aa, Artificial Sequence
  Description of Artificial Sequence: Synthetic peptide
EVQLVESGPGLVKPSATLSLTCTVSG

SEQ ID NO: 9004 - protein, 9 aa, Artificial Sequence
  Description of Artificial Sequence: Synthetic peptide
GSINNYYWT

SEQ ID NO: 9005 - protein, 14 aa, Artificial Sequence
  Description of Artificial Sequence: Synthetic peptide
WVRQSAGKGLEWIG

SEQ ID NO: 9006 - protein, 16 aa, Artificial Sequence
  Description of Artificial Sequence: Synthetic peptide
RINTSGSTNYNASLKS

SEQ ID NO: 9007 - protein, 30 aa, Artificial Sequence
  Description of Artificial Sequence: Synthetic polypeptide
RVTMSIDTSKNEFSLRLSSVTAADTAVYYC

SEQ ID NO: 9008 - protein, 19 aa, Artificial Sequence
  Description of Artificial Sequence: Synthetic peptide
AREFGVRFLDRSLFGAMDV

SEQ ID NO: 9009 - protein, 11 aa, Artificial Sequence
  Description of Artificial Sequence: Synthetic peptide
WGHGATVTVSS

SEQ ID NO: 9010 - DNA, 375 bp, Artificial Sequence
  Description of Artificial Sequence: Synthetic polynucleotide
gaggtgcagctggtggagtcgggcccaggactggtgaagccttcggcgaccctgtccctcacgtgcactgtctctggtggctccatcaacaattactactggacctgggtccgacagtccgccgggaagggactggagtggattgggcgtatcaacaccagtgggagcaccaactacaacgcctccctcaagagtcgagtcaccatgtcaatagacacgtccaagaatgagttctccctgaggctgagctctgtgaccgccgcggacacggccgtctattattgtgcgagagagtttggtgtgcgatttttggaccggtcattatttggggctatggacgtctggggccatggagccacggtcaccgtctcctca

SEQ ID NO: 9011 - skipped

SEQ ID NO: 9012 - protein, 111 aa, Artificial Sequence
  Description of Artificial Sequence: Synthetic polypeptide
QPVLTQPASVSGSPGQSITISCTGTSSDVGSFNYVSWYQQHPGKAPKLVIYDVYNRPSGVSNRFSGSKSGNTASLTISGLQAEDEADYYCSSYTSSSTLYVFGTGTKVTVL

SEQ ID NO: 9013 - protein, 22 aa, Artificial Sequence
  Description of Artificial Sequence: Synthetic peptide
QPVLTQPASVSGSPGQSITISC

SEQ ID NO: 9014 - protein, 14 aa, Artificial Sequence
  Description of Artificial Sequence: Synthetic peptide
TGTSSDVGSFNYVS

SEQ ID NO: 9015 - protein, 15 aa, Artificial Sequence
  Description of Artificial Sequence: Synthetic peptide
WYQQHPGKAPKLVIY

SEQ ID NO: 9016 - protein, 7 aa, Artificial Sequence
  Description of Artificial Sequence: Synthetic peptide
DVYNRPS

SEQ ID NO: 9017 - protein, 32 aa, Artificial Sequence
  Description of Artificial Sequence: Synthetic polypeptide
GVSNRFSGSKSGNTASLTISGLQAEDEADYYC

SEQ ID NO: 9018 - protein, 11 aa, Artificial Sequence
  Description of Artificial Sequence: Synthetic peptide
SSYTSSSTLYV

SEQ ID NO: 9019 - protein, 10 aa, Artificial Sequence
  Description of Artificial Sequence: Synthetic peptide
FGTGTKVTVL

SEQ ID NO: 9020 - DNA, 333 bp, Artificial Sequence
  Description of Artificial Sequence: Synthetic polynucleotide
cagcctgtgctgactcagcctgcctccgtgtctgggtctcctggacagtcgatcaccatctcctgcactggaaccagcagtgacgttggtagttttaactatgtctcctggtaccaacaacacccaggcaaagcccccaaactcgtgatttatgatgtctataatcggccctcaggggtttctaatcgcttctctggctccaagtctggcaacacggcctccctgaccatctctgggctccaggctgaggacgaggctgattattactgcagctcatatacaagcagcagcaccctttacgtcttcggaactgggaccaaggtcaccgtcctg

SEQ ID NO: 9021-9101 - skipped (81 entries)

SEQ ID NO: 9102 - protein, 119 aa, Artificial Sequence
  Description of Artificial Sequence: Synthetic polypeptide
QVQLVESGGGVVQPGRSLRLSCAASGFTFSAFAMHWVRQAPGKGLEWVTIISYDGSNEYYADSVQGRFSISRDNSKNTLFLQMSSLRTEDTAIYYCARAGGYLSAFDIWGQGTTVTVSS

SEQ ID NO: 9103 - protein, 26 aa, Artificial Sequence
  Description of Artificial Sequence: Synthetic peptide
QVQLVESGGGVVQPGRSLRLSCAASG

SEQ ID NO: 9104 - protein, 9 aa, Artificial Sequence
  Description of Artificial Sequence: Synthetic peptide
FTFSAFAMH

SEQ ID NO: 9105 - protein, 14 aa, Artificial Sequence
  Description of Artificial Sequence: Synthetic peptide
WVRQAPGKGLEWVT

SEQ ID NO: 9106 - protein, 17 aa, Artificial Sequence
  Description of Artificial Sequence: Synthetic peptide
IISYDGSNEYYADSVQG

SEQ ID NO: 9107 - protein, 30 aa, Artificial Sequence
  Description of Artificial Sequence: Synthetic polypeptide
RFSISRDNSKNTLFLQMSSLRTEDTAIYYC

SEQ ID NO: 9108 - protein, 12 aa, Artificial Sequence
  Description of Artificial Sequence: Synthetic peptide
ARAGGYLSAFDI

SEQ ID NO: 9109 - protein, 11 aa, Artificial Sequence
  Description of Artificial Sequence: Synthetic peptide
WGQGTTVTVSS

SEQ ID NO: 9110 - DNA, 357 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtgcgtttgctatgcactgggtccgccaggctccaggcaaggggctggagtgggtgacaattatatcatatgatggaagcaatgaatactacgcagactccgtgcagggccgattcagcatctccagagacaattccaagaacacgttgtttctgcaaatgagtagcctgagaactgaggacacggctatatattactgtgcgagagccggaggttatctatctgcttttgatatctggggccaagggaccacggtcaccgtctcctca

SEQ ID NO: 9111 - skipped

SEQ ID NO: 9112 - protein, 106 aa, Artificial Sequence
  Description of Artificial Sequence: Synthetic polypeptide
DIRLTQSPSTLSASVGDRVTITCRASQSISSWLAWYQQKPGKAPNLLIYKASTLESGVPSRFSGSGSGTEFTLTISSLQPDDFATYYCQQYNSGWTFGQGTKVEIK

SEQ ID NO: 9113 - protein, 23 aa, Artificial Sequence
  Description of Artificial Sequence: Synthetic peptide
DIRLTQSPSTLSASVGDRVTITC

SEQ ID NO: 9114 - protein, 11 aa, Artificial Sequence
  Description of Artificial Sequence: Synthetic peptide
RASQSISSWLA

SEQ ID NO: 9115 - protein, 15 aa, Artificial Sequence
  Description of Artificial Sequence: Synthetic peptide
WYQQKPGKAPNLLIY

SEQ ID NO: 9116 - protein, 7 aa, Artificial Sequence
  Description of Artificial Sequence: Synthetic peptide
KASTLES

SEQ ID NO: 9117 - protein, 32 aa, Artificial Sequence; identical to SEQ ID NO: 6717
  Description of Artificial Sequence: Synthetic polypeptide

SEQ ID NO: 9118 - protein, 8 aa, Artificial Sequence
  Description of Artificial Sequence: Synthetic peptide
QQYNSGWT

SEQ ID NO: 9119 - protein, 10 aa, Artificial Sequence
  Description of Artificial Sequence: Synthetic peptide
FGQGTKVEIK

SEQ ID NO: 9120 - DNA, 318 bp, Artificial Sequence
  Description of Artificial Sequence: Synthetic polynucleotide
gacatccggttgacccagtctccttccaccctgtctgcatctgtaggagacagagtcaccatcacttgccgggccagtcagagtattagtagttggttggcctggtatcagcagaaaccagggaaagcccctaacctcctgatctataaggcatctactttagaaagtggggtcccatcaaggttcagcggcagtggatctgggacagaattcactctcaccatcagcagcctgcagcctgatgattttgcaacttattactgccaacagtataatagtgggtggacgttcggccaagggaccaaggtggaaatcaaa

SEQ ID NO: 9121-9201 - skipped (81 entries)

SEQ ID NO: 9202 - protein, 126 aa, Artificial Sequence
  Description of Artificial Sequence: Synthetic polypeptide
EVQLVQSGAEVKKPGSSVKVSCKVSGGTFSNYAISWLRQAPGQGPEWMGGIIPALSKVGYAGKFQARLTFSADELKTTVYMDLSSLTSEDTAVYYCARDPSFLNAGNHFYYDFDVWGQGTMVTVSS

SEQ ID NO: 9203 - protein, 26 aa, Artificial Sequence
  Description of Artificial Sequence: Synthetic peptide
EVQLVQSGAEVKKPGSSVKVSCKVSG

SEQ ID NO: 9204 - protein, 9 aa, Artificial Sequence
  Description of Artificial Sequence: Synthetic peptide
GTFSNYAIS

SEQ ID NO: 9205 - protein, 14 aa, Artificial Sequence
  Description of Artificial Sequence: Synthetic peptide
WLRQAPGQGPEWMG

SEQ ID NO: 9206 - protein, 17 aa, Artificial Sequence
  Description of Artificial Sequence: Synthetic peptide
GIIPALSKVGYAGKFQA

SEQ ID NO: 9207 - protein, 30 aa, Artificial Sequence
  Description of Artificial Sequence: Synthetic polypeptide
RLTFSADELKTTVYMDLSSLTSEDTAVYYC

SEQ ID NO: 9208 - protein, 19 aa, Artificial Sequence
  Description of Artificial Sequence: Synthetic peptide
ARDPSFLNAGNHFYYDFDV

SEQ ID NO: 9209 - protein, 11 aa, Artificial Sequence
  Description of Artificial Sequence: Synthetic peptide
WGQGTMVTVSS

SEQ ID NO: 9210 - DNA, 378 bp, Artificial Sequence
  Description of Artificial Sequence: Synthetic polynucleotide
gaggtgcagctggtgcagtctggggctgaagtgaagaagcctgggtcctcggtgaaggtctcctgcaaggtttctggaggcaccttcagcaactacgctatcagttggctgcgacaggcccctgggcaagggcctgagtggatgggagggatcatccctgcgttgagtaaagtaggctacgctgggaagttccaggccagactcacgtttagcgcggacgagttgaagactacagtctacatggacctgagcagcctaacgtctgaggacacggccgtctattactgtgcgagagatccgtcgtttcttaatgctgggaatcacttctactatgattttgatgtgtggggccaagggacaatggtcaccgtctcttca

SEQ ID NO: 9211 - skipped

SEQ ID NO: 9212 - protein, 112 aa, Artificial Sequence
  Description of Artificial Sequence: Synthetic polypeptide
DIRLTQSPLSLPVTLGQPASISCTSSQDVVHTDGNTYLNWFHQRPGQSPRRLIYKVSNRDSGVPDRFSGSGSGSHFTLKISRVEAEDAGIYYCMQGTDWPRTFGQGTKVDIK

SEQ ID NO: 9213 - protein, 23 aa, Artificial Sequence
  Description of Artificial Sequence: Synthetic peptide
DIRLTQSPLSLPVTLGQPASISC

SEQ ID NO: 9214 - protein, 16 aa, Artificial Sequence
  Description of Artificial Sequence: Synthetic peptide
TSSQDVVHTDGNTYLN

SEQ ID NO: 9215 - protein, 15 aa, Artificial Sequence
  Description of Artificial Sequence: Synthetic peptide
WFHQRPGQSPRRLIY

SEQ ID NO: 9216 - protein, 7 aa, Artificial Sequence
  Description of Artificial Sequence: Synthetic peptide
KVSNRDS

SEQ ID NO: 9217 - protein, 32 aa, Artificial Sequence
  Description of Artificial Sequence: Synthetic polypeptide
GVPDRFSGSGSGSHFTLKISRVEAEDAGIYYC

SEQ ID NO: 9218 - protein, 9 aa, Artificial Sequence
  Description of Artificial Sequence: Synthetic peptide
MQGTDWPRT

SEQ ID NO: 9219 - protein, 10 aa, Artificial Sequence
  Description of Artificial Sequence: Synthetic peptide
FGQGTKVDIK

SEQ ID NO: 9220 - DNA, 336 bp, Artificial Sequence
  Description of Artificial Sequence: Synthetic polynucleotide
gacatccggttgacccagtctccactctccctgcccgtcacccttggacagccggcctccatctcctgcacgtctagtcaagacgtcgttcacactgatggaaacacctacctgaattggtttcaccagaggccaggccaatctccgaggcgcctcatttataaggtttctaaccgggactctggggtcccagacaggttcagtggcagtgggtcaggctctcatttcacactgaaaatcagcagggtggaggctgaggatgctgggatttattactgcatgcaaggtacagactggcctcggacgttcggccaagggaccaaagtggatatcaaa

SEQ ID NO: 9221-9301 - skipped (81 entries)

SEQ ID NO: 9302 - protein, 125 aa, Artificial Sequence
  Description of Artificial Sequence: Synthetic polypeptide
QVQLQESGPGLVKPSGTLSLTCAVSGGSITSRDWWSWVRQPPGKGLEWIGEVYHSGSTSYNPSLKSRVTISVDKSKNEFSLKLSSVTAADTAVYYCARAGNIVVMPAAQYYFDYWGQGTLVTVSS

SEQ ID NO: 9303 - protein, 26 aa, Artificial Sequence
  Description of Artificial Sequence: Synthetic peptide
QVQLQESGPGLVKPSGTLSLTCAVSG

SEQ ID NO: 9304 - protein, 10 aa, Artificial Sequence
  Description of Artificial Sequence: Synthetic peptide
GSITSRDWWS

SEQ ID NO: 9305 - protein, 14 aa, Artificial Sequence
  Description of Artificial Sequence: Synthetic peptide
WVRQPPGKGLEWIG

SEQ ID NO: 9306 - protein, 16 aa, Artificial Sequence
  Description of Artificial Sequence: Synthetic peptide
EVYHSGSTSYNPSLKS

SEQ ID NO: 9307 - protein, 30 aa, Artificial Sequence
  Description of Artificial Sequence: Synthetic polypeptide
RVTISVDKSKNEFSLKLSSVTAADTAVYYC

SEQ ID NO: 9308 - protein, 18 aa, Artificial Sequence
  Description of Artificial Sequence: Synthetic peptide
ARAGNIVVMPAAQYYFDY

SEQ ID NO: 9309 - protein, 11 aa, Artificial Sequence
  Description of Artificial Sequence: Synthetic peptide
WGQGTLVTVSS

SEQ ID NO: 9310 - DNA, 375 bp, Artificial Sequence
  Description of Artificial Sequence: Synthetic polynucleotide
caggtgcagctgcaggagtcgggcccaggactggtgaagccttcggggaccctgtccctcacctgcgctgtttctggtggctccattaccagtcgtgactggtggagttgggtccgccagcccccagggaaggggctggagtggattggagaagtctatcatagtgggagcaccagctacaacccgtccctcaagagtcgagtcaccatatcagtagacaagtccaagaatgagttctccctgaagctgagctctgtgaccgccgcggacacggccgtgtattactgtgcgcgagccggaaatattgtagtaatgccagctgcccaatactattttgactactggggccagggaaccctggtcaccgtctcttca

SEQ ID NO: 9311 - skipped

SEQ ID NO: 9312 - protein, 106 aa, Artificial Sequence
  Description of Artificial Sequence: Synthetic polypeptide
EIVLTQSPSSLSASVGDRVTITCRASQDISNYLAWYQQKPGKAPKLLIYAASTLQSGVPLRFSGSGSGTDFTLTISSLQPEDFATYYCLQLHNYSSFGGGTKVDIK

SEQ ID NO: 9313 - protein, 23 aa, Artificial Sequence
  Description of Artificial Sequence: Synthetic peptide
EIVLTQSPSSLSASVGDRVTITC

SEQ ID NO: 9314 - protein, 11 aa, Artificial Sequence
  Description of Artificial Sequence: Synthetic peptide
RASQDISNYLA

SEQ ID NO: 9315 - protein, 15 aa, Artificial Sequence
  Description of Artificial Sequence: Synthetic peptide
WYQQKPGKAPKLLIY

SEQ ID NO: 9316 - protein, 7 aa, Artificial Sequence
  Description of Artificial Sequence: Synthetic peptide
AASTLQS

SEQ ID NO: 9317 - protein, 32 aa, Artificial Sequence
  Description of Artificial Sequence: Synthetic polypeptide
GVPLRFSGSGSGTDFTLTISSLQPEDFATYYC

SEQ ID NO: 9318 - protein, 8 aa, Artificial Sequence
  Description of Artificial Sequence: Synthetic peptide
LQLHNYSS

SEQ ID NO: 9319 - protein, 10 aa, Artificial Sequence
  Description of Artificial Sequence: Synthetic peptide
FGGGTKVDIK

SEQ ID NO: 9320 - DNA, 318 bp, Artificial Sequence
  Description of Artificial Sequence: Synthetic polynucleotide
gaaattgtgttgacacagtctccatcctccctgtctgcatctgtaggagacagagtcaccatcacttgccgggccagtcaggacattagcaattatttagcctggtatcagcaaaaaccagggaaagcccctaaactcctgatctatgctgcatccactttgcaaagtggggtcccattaaggttcagcggcagtggatctgggacagatttcactctcaccatcagcagcctgcagcctgaagattttgcaacttattactgtctacagcttcataattactcttctttcggcggagggaccaaagtggatatcaaa

SEQ ID NO: 9321-9401 - skipped (81 entries)

SEQ ID NO: 9402 - protein, 127 aa, Artificial Sequence
  Description of Artificial Sequence: Synthetic polypeptide
EVQLVESGGSVVQPGTSLKLSCAGSAGLTITRYAMHWVRQAPGKGLEWVALVSHDGIHIGYSDSVRGRFTISRDNSRNTLYLQMDGLRPEDTAVYYCVRDDVLQHSRPSGPGYFVSWGQGTLVTVSS

SEQ ID NO: 9403 - protein, 27 aa, Artificial Sequence
  Description of Artificial Sequence: Synthetic peptide
EVQLVESGGSVVQPGTSLKLSCAGSAG

SEQ ID NO: 9404 - protein, 9 aa, Artificial Sequence
  Description of Artificial Sequence: Synthetic peptide
LTITRYAMH

SEQ ID NO: 9405 - protein, 14 aa, Artificial Sequence
  Description of Artificial Sequence: Synthetic peptide
WVRQAPGKGLEWVA

SEQ ID NO: 9406 - protein, 17 aa, Artificial Sequence
  Description of Artificial Sequence: Synthetic peptide
LVSHDGIHIGYSDSVRG

SEQ ID NO: 9407 - protein, 30 aa, Artificial Sequence
  Description of Artificial Sequence: Synthetic polypeptide
RFTISRDNSRNTLYLQMDGLRPEDTAVYYC

SEQ ID NO: 9408 - protein, 19 aa, Artificial Sequence
  Description of Artificial Sequence: Synthetic peptide
VRDDVLQHSRPSGPGYFVS

SEQ ID NO: 9409 - protein, 11 aa, Artificial Sequence
  Description of Artificial Sequence: Synthetic peptide
WGQGTLVTVSS

SEQ ID NO: 9410 - DNA, 381 bp, Artificial Sequence
  Description of Artificial Sequence: Synthetic polynucleotide
gaggtgcagctggtggagtctgggggctccgttgtccagcctgggacgtccctgaaactctcctgtgcagggtccgctggactcactatcactcgctatgctatgcactgggtccgccaggctccaggcaaaggcctggagtgggtggctcttgtgtcacatgatggcatccacataggatattcagactccgtgaggggccgattcaccatctccagagacaactccaggaacacactgtatctccaaatggacggcctgagacctgaagacacggctgtctattactgtgtaagagatgacgtattacagcactctcggccctctgggcccggatactttgtctcgtggggccagggaaccctggtcactgtctcctca

SEQ ID NO: 9411 - skipped

SEQ ID NO: 9412 - protein, 106 aa, Artificial Sequence
  Description of Artificial Sequence: Synthetic polypeptide
EIVLTQSPATLSLSPGERATLSCRASQSVSTFLGWYQQRPGQPPRLLIYDASYRAPDIPVRFSGSGSGTDFTLTINSLEPEDSAVYYCQQRSDGYNFGPGTKLEIK

SEQ ID NO: 9413 - protein, 23 aa, Artificial Sequence
  Description of Artificial Sequence: Synthetic peptide
EIVLTQSPATLSLSPGERATLSC

SEQ ID NO: 9414 - protein, 11 aa, Artificial Sequence
  Description of Artificial Sequence: Synthetic peptide
RASQSVSTFLG

SEQ ID NO: 9415 - protein, 15 aa, Artificial Sequence
  Description of Artificial Sequence: Synthetic peptide
WYQQRPGQPPRLLIY

SEQ ID NO: 9416 - protein, 7 aa, Artificial Sequence
  Description of Artificial Sequence: Synthetic peptide
DASYRAP

SEQ ID NO: 9417 - protein, 32 aa, Artificial Sequence
  Description of Artificial Sequence: Synthetic polypeptide
DIPVRFSGSGSGTDFTLTINSLEPEDSAVYYC

SEQ ID NO: 9418 - protein, 8 aa, Artificial Sequence
  Description of Artificial Sequence: Synthetic peptide
QQRSDGYN

SEQ ID NO: 9419 - protein, 10 aa, Artificial Sequence
  Description of Artificial Sequence: Synthetic peptide
FGPGTKLEIK

SEQ ID NO: 9420 - DNA, 318 bp, Artificial Sequence
  Description of Artificial Sequence: Synthetic polynucleotide
gaaattgtgttgacacagtctccagccaccctgtctttgtctccaggggaaagggccaccctctcctgcagggccagtcagagtgttagcaccttcttaggctggtaccaacagagacctggccagcctcccaggctcctcatttatgatgcatcctacagggcccctgacatcccagtcagattcagtggcagtgggtctgggacagacttcactctcaccatcaacagcctagagcctgaagattctgcagtttactactgtcagcagcgtagtgacgggtacaattttggcccggggaccaagctggagatcaaa

SEQ ID NO: 9421-9501 - skipped (81 entries)

SEQ ID NO: 9502 - protein, 125 aa, Artificial Sequence
  Description of Artificial Sequence: Synthetic polypeptide
QVQLQESGPGLVKPSETLSLTCTVSGGSMNHYYWSWIRQPPGKGLEGIGYTYYSGSTNYNPSLKSRVTISVDASKNQFSLRLSSVTAADTAVYYCARGSQIDLRGGLGATFFDYWGQGTLVTVSS

SEQ ID NO: 9503 - protein, 26 aa, Artificial Sequence
  Description of Artificial Sequence: Synthetic peptide
QVQLQESGPGLVKPSETLSLTCTVSG

SEQ ID NO: 9504 - protein, 9 aa, Artificial Sequence
  Description of Artificial Sequence: Synthetic peptide
GSMNHYYWS

SEQ ID NO: 9505 - protein, 14 aa, Artificial Sequence
  Description of Artificial Sequence: Synthetic peptide
WIRQPPGKGLEGIG

SEQ ID NO: 9506 - protein, 16 aa, Artificial Sequence
  Description of Artificial Sequence: Synthetic peptide
YTYYSGSTNYNPSLKS

SEQ ID NO: 9507 - protein, 30 aa, Artificial Sequence
  Description of Artificial Sequence: Synthetic polypeptide
RVTISVDASKNQFSLRLSSVTAADTAVYYC

SEQ ID NO: 9508 - protein, 19 aa, Artificial Sequence
  Description of Artificial Sequence: Synthetic peptide
ARGSQIDLRGGLGATFFDY

SEQ ID NO: 9509 - protein, 11 aa, Artificial Sequence
  Description of Artificial Sequence: Synthetic peptide
WGQGTLVTVSS

SEQ ID NO: 9510 - DNA, 375 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatgaatcattactactggagctggatccggcagccccccgggaagggactggagggcattgggtatacctattacagtgggagcaccaattacaacccctccctcaagagtcgagtcaccatatcagtagacgcgtccaagaaccagttctccctgaggctgagctctgtgaccgctgcggacacggccgtgtattactgtgcgagaggttcacagatcgaccttcgaggcggactgggggcgaccttctttgactactggggccagggaaccctggtcaccgtctcctca

SEQ ID NO: 9511 - skipped

SEQ ID NO: 9512 - protein, 109 aa, Artificial Sequence
  Description of Artificial Sequence: Synthetic polypeptide
QSVLTQPASVSGSPGQSITISCTGTSSDVGAYNYVSWYQQHPGKAPKLTVYDVRNRPSGVSNRFSGSKSGNTASLTISGLQAEDEAHYYCSSYTSTNTVFGGGTKLTVL

SEQ ID NO: 9513 - protein, 22 aa, Artificial Sequence
  Description of Artificial Sequence: Synthetic peptide
QSVLTQPASVSGSPGQSITISC

SEQ ID NO: 9514 - protein, 14 aa, Artificial Sequence
  Description of Artificial Sequence: Synthetic peptide
TGTSSDVGAYNYVS

SEQ ID NO: 9515 - protein, 15 aa, Artificial Sequence
  Description of Artificial Sequence: Synthetic peptide
WYQQHPGKAPKLTVY

SEQ ID NO: 9516 - protein, 7 aa, Artificial Sequence
  Description of Artificial Sequence: Synthetic peptide
DVRNRPS

SEQ ID NO: 9517 - protein, 32 aa, Artificial Sequence
  Description of Artificial Sequence: Synthetic polypeptide
GVSNRFSGSKSGNTASLTISGLQAEDEAHYYC

SEQ ID NO: 9518 - protein, 9 aa, Artificial Sequence
  Description of Artificial Sequence: Synthetic peptide
SSYTSTNTV

SEQ ID NO: 9519 - protein, 10 aa, Artificial Sequence
  Description of Artificial Sequence: Synthetic peptide
FGGGTKLTVL

SEQ ID NO: 9520 - DNA, 327 bp, Artificial Sequence
  Description of Artificial Sequence: Synthetic polynucleotide
cagtctgtgctgactcagcctgcctccgtgtctgggtctcctggacagtcgatcaccatctcctgcactggaaccagcagtgacgttggtgcttataactatgtctcctggtaccaacagcacccaggcaaagcccccaaactcacggtttatgatgtccgtaatcggccctcaggggtttctaatcgcttctctggctccaagtctggcaacacggcctccctgaccatctctgggctccaggctgaggacgaggcgcattattactgcagctcatatacaagcactaacacagtattcggcggagggaccaagctgaccgtccta

SEQ ID NO: 9521-9601 - skipped (81 entries)

SEQ ID NO: 9602 - protein, 129 aa, Artificial Sequence
  Description of Artificial Sequence: Synthetic polypeptide
QVQLVESGAEVKKPGSSVKISCKISGDTFSTNAISWLRQAPGREPEWMGGIVPLVGPASYAQRPQGRLTITADEFTNTAYLELNSLRSEDTATYYCARDSDPYTATRRHNHYWYAMDVWGQGTTVTVSS

SEQ ID NO: 9603 - protein, 26 aa, Artificial Sequence
  Description of Artificial Sequence: Synthetic peptide
QVQLVESGAEVKKPGSSVKISCKISG

SEQ ID NO: 9604 - protein, 9 aa, Artificial Sequence
  Description of Artificial Sequence: Synthetic peptide
DTFSTNAIS

SEQ ID NO: 9605 - protein, 14 aa, Artificial Sequence
  Description of Artificial Sequence: Synthetic peptide
WLRQAPGREPEWMG

SEQ ID NO: 9606 - protein, 17 aa, Artificial Sequence
  Description of Artificial Sequence: Synthetic peptide
GIVPLVGPASYAQRPQG

SEQ ID NO: 9607 - protein, 30 aa, Artificial Sequence
  Description of Artificial Sequence: Synthetic polypeptide
RLTITADEFTNTAYLELNSLRSEDTATYYC

SEQ ID NO: 9608 - protein, 22 aa, Artificial Sequence
  Description of Artificial Sequence: Synthetic peptide
ARDSDPYTATRRHNHYWYAMDV

SEQ ID NO: 9609 - protein, 11 aa, Artificial Sequence
  Description of Artificial Sequence: Synthetic peptide
WGQGTTVTVSS

SEQ ID NO: 9610 - DNA, 387 bp, Artificial Sequence
  Description of Artificial Sequence: Synthetic polynucleotide
caggtgcagctggtggagtctggggctgaggtgaagaaacctgggtcctcggtgaagatctcctgcaagatttctggagacactttcagcaccaatgctattagttggttgcgacaggcccctgggcgagagcctgaatggatggggggcatcgtccctctggttggccctgcaagctatgcccagaggccccagggccgattgacgattaccgcggacgaatttaccaacacagcctacttggaactgaacagcctgagatctgaggacacggccacatattactgtgcaagagactctgacccctatacggcgactagaaggcacaatcactattggtatgccatggacgtctggggccaagggaccacggtcaccgtctcctca

SEQ ID NO: 9611 - skipped

SEQ ID NO: 9612 - protein, 112 aa, Artificial Sequence
  Description of Artificial Sequence: Synthetic polypeptide
DIRLTQTPLSLPVTLGQPASISCRSSQIAMHSDGNTYLSWFHQRPGQPPRRLIYKISNRDSGVPDRFSGSGSGTDFTLKISRVEAEDIGTFYCMQGTDWPRTFGQGTKVDIK

SEQ ID NO: 9613 - protein, 23 aa, Artificial Sequence
  Description of Artificial Sequence: Synthetic peptide
DIRLTQTPLSLPVTLGQPASISC

SEQ ID NO: 9614 - protein, 16 aa, Artificial Sequence
  Description of Artificial Sequence: Synthetic peptide
RSSQIAMHSDGNTYLS

SEQ ID NO: 9615 - protein, 15 aa, Artificial Sequence
  Description of Artificial Sequence: Synthetic peptide
WFHQRPGQPPRRLIY

SEQ ID NO: 9616 - protein, 7 aa, Artificial Sequence
  Description of Artificial Sequence: Synthetic peptide
KISNRDS

SEQ ID NO: 9617 - protein, 32 aa, Artificial Sequence
  Description of Artificial Sequence: Synthetic polypeptide
GVPDRFSGSGSGTDFTLKISRVEAEDIGTFYC

SEQ ID NO: 9618 - protein, 9 aa, Artificial Sequence
  Description of Artificial Sequence: Synthetic peptide
MQGTDWPRT

SEQ ID NO: 9619 - protein, 10 aa, Artificial Sequence
  Description of Artificial Sequence: Synthetic peptide
FGQGTKVDIK

SEQ ID NO: 9620 - DNA, 336 bp, Artificial Sequence
  Description of Artificial Sequence: Synthetic polynucleotide
gacatccggttgacccagactcccctgtccctgcccgtcacccttggacagccggcctccatctcctgcaggtctagtcaaatcgccatgcacagtgatggcaacacctacttgagttggtttcaccagaggccaggccaacctccacggcgcctaatttataagatttccaatcgggactctggggtcccagacagattcagcggcagtgggtcaggcacagacttcacactgaaaatcagtagggtggaggctgaggatattggaactttttattgcatgcaaggtacagactggcctcggacttttggccaggggaccaaagtggatatcaaa

SEQ ID NO: 9621-9701 - skipped (81 entries)

SEQ ID NO: 9702 - protein, 117 aa, Artificial Sequence
  Description of Artificial Sequence: Synthetic polypeptide
EVQLLESGGGLVQPGGSLRLSCAASGFIFKNEPMNWIRQFPGKGLEWISNIRDNGNDVYYADSVKGRFTVSRDNAKNSLYLQMNSLRDDDTALYYCVRDTDWAFDSWGQGTLVTVSS

SEQ ID NO: 9703 - protein, 26 aa, Artificial Sequence
  Description of Artificial Sequence: Synthetic peptide
EVQLLESGGGLVQPGGSLRLSCAASG

SEQ ID NO: 9704 - protein, 9 aa, Artificial Sequence
  Description of Artificial Sequence: Synthetic peptide
FIFKNEPMN

SEQ ID NO: 9705 - protein, 14 aa, Artificial Sequence
  Description of Artificial Sequence: Synthetic peptide
WIRQFPGKGLEWIS

SEQ ID NO: 9706 - protein, 17 aa, Artificial Sequence
  Description of Artificial Sequence: Synthetic peptide
NIRDNGNDVYYADSVKG

SEQ ID NO: 9707 - protein, 30 aa, Artificial Sequence; identical to SEQ ID NO: 6807
  Description of Artificial Sequence: Synthetic polypeptide

SEQ ID NO: 9708 - protein, 10 aa, Artificial Sequence
  Description of Artificial Sequence: Synthetic peptide
VRDTDWAFDS

SEQ ID NO: 9709 - protein, 11 aa, Artificial Sequence
  Description of Artificial Sequence: Synthetic peptide
WGQGTLVTVSS

SEQ ID NO: 9710 - DNA, 351 bp, Artificial Sequence
  Description of Artificial Sequence: Synthetic polynucleotide
gaggtgcagctgttggagtctgggggaggcttggtacagccgggggggtccctgagactctcttgtgcagcctctggattcatcttcaaaaacgagcccatgaactggatccgccagttcccagggaagggactggagtggatttcaaatattagagacaatggaaatgatgtttactacgcggactctgtgaagggccgattcaccgtctccagagacaatgccaagaattcactgtatctgcaaatgaacagcctaagagacgacgacacggctttgtattattgtgtgagagacacagactgggcctttgactcctggggccagggaaccctggtcaccgtctcctca

SEQ ID NO: 9711 - skipped

SEQ ID NO: 9712 - protein, 110 aa, Artificial Sequence
  Description of Artificial Sequence: Synthetic polypeptide
QSALIQPRSVSGSPGQSVTISCTGSSSTFGTDNHISWYQQLPGKVPKLIIHAVSQRPSVVPDRFSGSRSGNTASLTISGLQAEDEADYYCCSSPGTITWVFGGGTKVTVL

SEQ ID NO: 9713 - protein, 22 aa, Artificial Sequence
  Description of Artificial Sequence: Synthetic peptide
QSALIQPRSVSGSPGQSVTISC

SEQ ID NO: 9714 - protein, 14 aa, Artificial Sequence
  Description of Artificial Sequence: Synthetic peptide
TGSSSTFGTDNHIS

SEQ ID NO: 9715 - protein, 15 aa, Artificial Sequence
  Description of Artificial Sequence: Synthetic peptide
WYQQLPGKVPKLIIH

SEQ ID NO: 9716 - protein, 7 aa, Artificial Sequence
  Description of Artificial Sequence: Synthetic peptide
AVSQRPS

SEQ ID NO: 9717 - protein, 32 aa, Artificial Sequence; identical to SEQ ID NO: 6817
  Description of Artificial Sequence: Synthetic polypeptide

SEQ ID NO: 9718 - protein, 10 aa, Artificial Sequence
  Description of Artificial Sequence: Synthetic peptide
CSSPGTITWV

SEQ ID NO: 9719 - protein, 10 aa, Artificial Sequence
  Description of Artificial Sequence: Synthetic peptide
FGGGTKVTVL

SEQ ID NO: 9720 - DNA, 330 bp, Artificial Sequence
  Description of Artificial Sequence: Synthetic polynucleotide
cagtctgccctgattcagcctcgctcagtgtccgggtctcctggacagtcagtcaccatctcctgcactggaagcagcagtacttttggcactgataaccatatctcctggtaccaacaactcccaggcaaagtccccaaactcatcattcatgctgtcagtcagcggccctcagttgtccctgatcgcttctctgggtccaggtctggcaacacggcctccctgaccatctctggcctccaggctgaagatgaggctgattattactgctgttcatcccctggcacaataacctgggtgtttggcggagggaccaaggtcaccgtccta

SEQ ID NO: 9721-9801 - skipped (81 entries)

SEQ ID NO: 9802 - protein, 127 aa, Artificial Sequence
  Description of Artificial Sequence: Synthetic polypeptide
QVQLVQSGADVKKPGASVKVSCKASGYTFTSYYMHWVRQAPGQGLEWLGVIHPSGGSTTFAQKFQGRVTMTRDTSTSTVYMELSSLRSEDTAVYYCARVLAGSSHEWQLTHDAFDIWGQGTTVTVSS

SEQ ID NO: 9803 - protein, 26 aa, Artificial Sequence
  Description of Artificial Sequence: Synthetic peptide
QVQLVQSGADVKKPGASVKVSCKASG

SEQ ID NO: 9804 - protein, 9 aa, Artificial Sequence
  Description of Artificial Sequence: Synthetic peptide
YTFTSYYMH

SEQ ID NO: 9805 - protein, 14 aa, Artificial Sequence
  Description of Artificial Sequence: Synthetic peptide
WVRQAPGQGLEWLG

SEQ ID NO: 9806 - protein, 17 aa, Artificial Sequence
  Description of Artificial Sequence: Synthetic peptide
VIHPSGGSTTFAQKFQG

SEQ ID NO: 9807 - protein, 30 aa, Artificial Sequence
  Description of Artificial Sequence: Synthetic polypeptide
RVTMTRDTSTSTVYMELSSLRSEDTAVYYC

SEQ ID NO: 9808 - protein, 20 aa, Artificial Sequence
  Description of Artificial Sequence: Synthetic peptide
ARVLAGSSHEWQLTHDAFDI

SEQ ID NO: 9809 - protein, 11 aa, Artificial Sequence
  Description of Artificial Sequence: Synthetic peptide
WGQGTTVTVSS

SEQ ID NO: 9810 - DNA, 381 bp, Artificial Sequence
  Description of Artificial Sequence: Synthetic polynucleotide
caggtccagctggtgcagtctggggctgacgtgaagaagcctggggcctcagtgaaggtttcctgcaaggcatctggatacaccttcaccagctactatatgcactgggtgcgacaggcccctggacaagggcttgagtggctgggagtaatccaccctagtggtggtagcacaaccttcgcacagaagttccagggcagagtcaccatgaccagggacacgtccacgagcacagtctacatggagctgagcagcctgagatctgaggacacggccgtgtattactgtgcgagagttttagcgggcagttcccacgagtggcaactaacacatgatgcttttgatatctggggccaagggaccacggtcaccgtctcttca

SEQ ID NO: 9811 - skipped

SEQ ID NO: 9812 - protein, 113 aa, Artificial Sequence
  Description of Artificial Sequence: Synthetic polypeptide
DIRMTQSPDSLAVSLGERATINCRTSQSVLYSSNNKNYLGWYQQKPGQPPKLLIYWASTRESGVPDRFSGSGSGTDFTLTISSLQAEDVAVYYCQQYYSTPYTFGQGTKVDIK

SEQ ID NO: 9813 - protein, 23 aa, Artificial Sequence
  Description of Artificial Sequence: Synthetic peptide
DIRMTQSPDSLAVSLGERATINC

SEQ ID NO: 9814 - protein, 17 aa, Artificial Sequence
  Description of Artificial Sequence: Synthetic peptide
RTSQSVLYSSNNKNYLG

SEQ ID NO: 9815 - protein, 15 aa, Artificial Sequence
  Description of Artificial Sequence: Synthetic peptide
WYQQKPGQPPKLLIY

SEQ ID NO: 9816 - protein, 7 aa, Artificial Sequence
  Description of Artificial Sequence: Synthetic peptide
WASTRES

SEQ ID NO: 9817 - protein, 32 aa, Artificial Sequence; identical to SEQ ID NO: 1617
  Description of Artificial Sequence: Synthetic polypeptide

SEQ ID NO: 9818 - protein, 9 aa, Artificial Sequence
  Description of Artificial Sequence: Synthetic peptide
QQYYSTPYT

SEQ ID NO: 9819 - protein, 10 aa, Artificial Sequence
  Description of Artificial Sequence: Synthetic peptide
FGQGTKVDIK

SEQ ID NO: 9820 - DNA, 339 bp, Artificial Sequence
  Description of Artificial Sequence: Synthetic polynucleotide
gacatccggatgacccagtctccagactccctggctgtgtctctgggcgagagggccaccatcaactgcaggaccagccagagtgttttatacagctccaacaataagaactacttaggttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcagtattatagtactccgtacacttttggccaggggaccaaagtggatatcaaa

SEQ ID NO: 9821-9901 - skipped (81 entries)

SEQ ID NO: 9902 - protein, 127 aa, Artificial Sequence
  Description of Artificial Sequence: Synthetic polypeptide
EVQLLESGGGLVQPGGSLRLSCAASGFTFSSYAMSWVRQAPGKGLEWVSGIDGGGGSSYYADSVRGRFTVSRDNSKNMLHLQMNSLRADDTAVYFCAKGDWIRYFDWSLPISFFDYWGQGALVTVSS

SEQ ID NO: 9903 - protein, 26 aa, Artificial Sequence
  Description of Artificial Sequence: Synthetic peptide
EVQLLESGGGLVQPGGSLRLSCAASG

SEQ ID NO: 9904 - protein, 9 aa, Artificial Sequence
  Description of Artificial Sequence: Synthetic peptide
FTFSSYAMS

SEQ ID NO: 9905 - protein, 14 aa, Artificial Sequence
  Description of Artificial Sequence: Synthetic peptide
WVRQAPGKGLEWVS

SEQ ID NO: 9906 - protein, 17 aa, Artificial Sequence
  Description of Artificial Sequence: Synthetic peptide
GIDGGGGSSYYADSVRG

SEQ ID NO: 9907 - protein, 30 aa, Artificial Sequence
  Description of Artificial Sequence: Synthetic polypeptide
RFTVSRDNSKNMLHLQMNSLRADDTAVYFC

SEQ ID NO: 9908 - protein, 20 aa, Artificial Sequence
  Description of Artificial Sequence: Synthetic peptide
AKGDWIRYFDWSLPISFFDY

SEQ ID NO: 9909 - protein, 11 aa, Artificial Sequence
  Description of Artificial Sequence: Synthetic peptide
WGQGALVTVSS

SEQ ID NO: 9910 - DNA, 381 bp, Artificial Sequence
  Description of Artificial Sequence: Synthetic polynucleotide
gaggtgcagctgttggagtctgggggaggcttggttcagccgggggggtcacttagactctcctgtgcagcctctggattcaccttcagcagctatgccatgagctgggtccgccaggctccagggaaggggctggagtgggtctcaggtattgatggtggtggaggtagctcctattacgcagactccgtgcggggccgattcaccgtctccagagacaattccaagaatatgctgcatcttcaaatgaacagcctgagagccgatgacacggccgtatatttttgtgcgaaaggagattggatacgatattttgactggtcattaccgatctcattctttgactactggggccagggagccctggtcactgtctcctca

SEQ ID NO: 9911 - skipped

SEQ ID NO: 9912 - protein, 111 aa, Artificial Sequence
  Description of Artificial Sequence: Synthetic polypeptide
QSALTQPASVSGSPGQSITISCTGTNSDISNSYSVSWYQQYPGKAPKLVIFDVINRPSGVSNRFSGSKSGNTASLTISGLQADDEADYYCCSYTRTNTPVLFGGGTKLTVL

SEQ ID NO: 9913 - protein, 22 aa, Artificial Sequence
  Description of Artificial Sequence: Synthetic peptide
QSALTQPASVSGSPGQSITISC

SEQ ID NO: 9914 - protein, 14 aa, Artificial Sequence
  Description of Artificial Sequence: Synthetic peptide
TGTNSDISNSYSVS

SEQ ID NO: 9915 - protein, 15 aa, Artificial Sequence
  Description of Artificial Sequence: Synthetic peptide
WYQQYPGKAPKLVIF

SEQ ID NO: 9916 - protein, 7 aa, Artificial Sequence
  Description of Artificial Sequence: Synthetic peptide
DVINRPS

SEQ ID NO: 9917 - protein, 32 aa, Artificial Sequence
  Description of Artificial Sequence: Synthetic polypeptide
GVSNRFSGSKSGNTASLTISGLQADDEADYYC

SEQ ID NO: 9918 - protein, 11 aa, Artificial Sequence
  Description of Artificial Sequence: Synthetic peptide
CSYTRTNTPVL

SEQ ID NO: 9919 - protein, 10 aa, Artificial Sequence
  Description of Artificial Sequence: Synthetic peptide
FGGGTKLTVL

SEQ ID NO: 9920 - DNA, 333 bp, Artificial Sequence
  Description of Artificial Sequence: Synthetic polynucleotide
cagtctgctctgactcagcctgcctccgtgtctgggtctcctggacagtcgatcaccatctcctgcactggaaccaacagtgacattagtaattcttactctgtctcctggtaccaacaatacccaggcaaagcccccaaactcgtgatttttgatgtcattaatcgaccctcaggggtttctaatcgcttctctggctccaagtctggcaacacggcctccctgaccatctctgggctccaggctgacgacgaggctgattactattgttgttcatatacacgtaccaacactcctgtgctattcggcggagggaccaagctcaccgtccta

SEQ ID NO: 9921-10001 - skipped (81 entries)

SEQ ID NO: 10002 - protein, 126 aa, Artificial Sequence
  Description of Artificial Sequence: Synthetic polypeptide
EVQLLESGPGLLKPSETLSLTCTVSGDSVSSGNFYWSWVRRPPGKALEWIAYSHYTGGTNSDPSFMGRVTMSIDPSRNQFSLRLTSVAAADTAVYYCARTTSPLTYSGHWPLFDYWGQGSLVTVSS

SEQ ID NO: 10003 - protein, 26 aa, Artificial Sequence
  Description of Artificial Sequence: Synthetic peptide
EVQLLESGPGLLKPSETLSLTCTVSG

SEQ ID NO: 10004 - protein, 11 aa, Artificial Sequence
  Description of Artificial Sequence: Synthetic peptide
DSVSSGNFYWS

SEQ ID NO: 10005 - protein, 14 aa, Artificial Sequence
  Description of Artificial Sequence: Synthetic peptide
WVRRPPGKALEWIA

SEQ ID NO: 10006 - protein, 16 aa, Artificial Sequence
  Description of Artificial Sequence: Synthetic peptide
YSHYTGGTNSDPSFMG

SEQ ID NO: 10007 - protein, 30 aa, Artificial Sequence
  Description of Artificial Sequence: Synthetic polypeptide
RVTMSIDPSRNQFSLRLTSVAAADTAVYYC

SEQ ID NO: 10008 - protein, 18 aa, Artificial Sequence
  Description of Artificial Sequence: Synthetic peptide
ARTTSPLTYSGHWPLFDY

SEQ ID NO: 10009 - protein, 11 aa, Artificial Sequence
  Description of Artificial Sequence: Synthetic peptide
WGQGSLVTVSS

SEQ ID NO: 10010 - DNA, 378 bp, Artificial Sequence
  Description of Artificial Sequence: Synthetic polynucleotide
gaggtgcagctgttggagtcgggcccaggactgctgaagccttcggagaccctgtccctcacctgcactgtctctggtgactccgtcagcagtgggaatttctactggagttgggtccggcggccccctgggaaggcactggaatggattgcctattcccattacactggcggcaccaactccgacccctccttcatgggtcgagtcaccatgtcaattgacccgtccaggaaccagttctccctgaggctgacctcagtggccgctgcggacacggccgtctattactgtgcgaggaccacgtcgcctttgacttatagcggccactggccgctctttgactactggggccagggatccctggtcaccgtctcctca

SEQ ID NO: 10011 - skipped

SEQ ID NO: 10012 - protein, 108 aa, Artificial Sequence
  Description of Artificial Sequence: Synthetic polypeptide
DIQLTQSPATLSVSPGERATLSCRASQSVTKHLAWYQQKPGQAPRLLIYGASTRATGVPARFSGSGSDTEFSLTISSLQSEDFAVYYCQQYYSWPPLTFGGGTKLEIK

SEQ ID NO: 10013 - protein, 23 aa, Artificial Sequence
  Description of Artificial Sequence: Synthetic peptide
DIQLTQSPATLSVSPGERATLSC

SEQ ID NO: 10014 - protein, 11 aa, Artificial Sequence
  Description of Artificial Sequence: Synthetic peptide
RASQSVTKHLA

SEQ ID NO: 10015 - protein, 15 aa, Artificial Sequence
  Description of Artificial Sequence: Synthetic peptide
WYQQKPGQAPRLLIY

SEQ ID NO: 10016 - protein, 7 aa, Artificial Sequence
  Description of Artificial Sequence: Synthetic peptide
GASTRAT

SEQ ID NO: 10017 - protein, 32 aa, Artificial Sequence
  Description of Artificial Sequence: Synthetic polypeptide
GVPARFSGSGSDTEFSLTISSLQSEDFAVYYC

SEQ ID NO: 10018 - protein, 10 aa, Artificial Sequence
  Description of Artificial Sequence: Synthetic peptide
QQYYSWPPLT

SEQ ID NO: 10019 - protein, 10 aa, Artificial Sequence
  Description of Artificial Sequence: Synthetic peptide
FGGGTKLEIK

SEQ ID NO: 10020 - DNA, 324 bp, Artificial Sequence
  Description of Artificial Sequence: Synthetic polynucleotide
gacatccagttgacccagtctccagccaccctgtctgtgtctccaggggaaagagccaccctctcctgcagggccagtcagagtgttactaagcacttagcctggtaccagcagaagcctggccaggctcccagactcctcatttatggtgcgtccaccagggccactggtgtcccagccaggttcagtggcagtgggtctgacacagagttcagtctcaccatcagcagcctgcagtctgaagattttgcagtttattactgtcaacaatattatagttggcctccgctcactttcggcggagggaccaagctggagatcaaa

SEQ ID NO: 10021-10101 - skipped (81 entries)

SEQ ID NO: 10102 - protein, 129 aa, Artificial Sequence; identical to SEQ ID NO: 5902
  Description of Artificial Sequence: Synthetic polypeptide

SEQ ID NO: 10103 - protein, 26 aa, Artificial Sequence
  Description of Artificial Sequence: Synthetic peptide
QVQLVQSGDEMKKPGSSVKVSCKASG

SEQ ID NO: 10104 - protein, 9 aa, Artificial Sequence
  Description of Artificial Sequence: Synthetic peptide
DTFSTHAIS

SEQ ID NO: 10105 - protein, 14 aa, Artificial Sequence
  Description of Artificial Sequence: Synthetic peptide
WVRQAPGQGPEWMG

SEQ ID NO: 10106 - protein, 17 aa, Artificial Sequence
  Description of Artificial Sequence: Synthetic peptide
GIIPLFGTASYAQTSQS

SEQ ID NO: 10107 - protein, 30 aa, Artificial Sequence; identical to SEQ ID NO: 5907
  Description of Artificial Sequence: Synthetic polypeptide

SEQ ID NO: 10108 - protein, 22 aa, Artificial Sequence
  Description of Artificial Sequence: Synthetic peptide
VRDSDPYTATSRNNHYWYGMDV

SEQ ID NO: 10109 - protein, 11 aa, Artificial Sequence
  Description of Artificial Sequence: Synthetic peptide
WGQGTTVTVSS

SEQ ID NO: 10110 - DNA, 387 bp, Artificial Sequence
  Description of Artificial Sequence: Synthetic polynucleotide
caggtccagctggtgcagtctggggatgagatgaagaagcctgggtcctcggtgaaggtctcctgcaaggcttctggagacaccttcagcacccatgctatcagctgggtgcgacaggcccctggacaagggcctgagtggatgggagggatcatccctctttttggcacagcaagttacgcacagacgtcgcagagcagagtcaagattaccgcggacgagtccacgagcacagcctacatggagctgagcagcctgacatctgaagacacggccgtgtattactgtgtgagagactctgacccctatacggcgaccagcaggaataatcactattggtatggaatggacgtctggggccaagggaccacggtcaccgtctcctca

SEQ ID NO: 10111 - skipped

SEQ ID NO: 10112 - protein, 112 aa, Artificial Sequence
  Description of Artificial Sequence: Synthetic polypeptide
DIVMTQTPLSLPVTLGQPASISCRASQTVVHTNGNTYLNWFHQRPGQSPRRLIYEVSNRDSGVPDRFSGSGSGTDFTLSISRVEAEDIGVYYCMQGTDWPRTFGPGTKVEIK

SEQ ID NO: 10113 - protein, 23 aa, Artificial Sequence
  Description of Artificial Sequence: Synthetic peptide
DIVMTQTPLSLPVTLGQPASISC

SEQ ID NO: 10114 - protein, 16 aa, Artificial Sequence
  Description of Artificial Sequence: Synthetic peptide
RASQTVVHTNGNTYLN

SEQ ID NO: 10115 - protein, 15 aa, Artificial Sequence
  Description of Artificial Sequence: Synthetic peptide
WFHQRPGQSPRRLIY

SEQ ID NO: 10116 - protein, 7 aa, Artificial Sequence
  Description of Artificial Sequence: Synthetic peptide
EVSNRDS

SEQ ID NO: 10117 - protein, 32 aa, Artificial Sequence; identical to SEQ ID NO: 5917
  Description of Artificial Sequence: Synthetic polypeptide

SEQ ID NO: 10118 - protein, 9 aa, Artificial Sequence
  Description of Artificial Sequence: Synthetic peptide
MQGTDWPRT

SEQ ID NO: 10119 - protein, 10 aa, Artificial Sequence
  Description of Artificial Sequence: Synthetic peptide
FGPGTKVEIK

SEQ ID NO: 10120 - DNA, 336 bp, Artificial Sequence
  Description of Artificial Sequence: Synthetic polynucleotide
gatattgtgatgacgcagactccgctctccctgcccgtcacccttggacagccggcctccatctcctgcagggctagtcaaaccgtcgtgcacactaatggaaacacctacttgaattggtttcaccagaggccaggccaatctccgaggcgcctaatttatgaggtttctaatcgggactctggggtcccagacagattcagcggcagtgggtcaggcactgacttcacactgagcatcagcagggtggaggctgaggatattggggtttattactgcatgcaaggtacagactggcctcggacttttggcccggggaccaaggtggaaatcaaa

SEQ ID NO: 10121-10201 - skipped (81 entries)

SEQ ID NO: 10202 - protein, 126 aa, Artificial Sequence
  Description of Artificial Sequence: Synthetic polypeptide
QVQLVQSGAEVKKPGSSVKVSCKASGGMFTDYAISWVRQAPGQRLEWMGGIMPGLGSPAYAQIFRDRATISADVSTSTAYLELTSLKPEDTAVYYCARDPSILNTGNHHWYDLDIWGQGTTVTVSS

SEQ ID NO: 10203 - protein, 26 aa, Artificial Sequence
  Description of Artificial Sequence: Synthetic peptide
QVQLVQSGAEVKKPGSSVKVSCKASG

SEQ ID NO: 10204 - protein, 9 aa, Artificial Sequence
  Description of Artificial Sequence: Synthetic peptide
GMFTDYAIS

SEQ ID NO: 10205 - protein, 14 aa, Artificial Sequence
  Description of Artificial Sequence: Synthetic peptide
WVRQAPGQRLEWMG

SEQ ID NO: 10206 - protein, 17 aa, Artificial Sequence
  Description of Artificial Sequence: Synthetic peptide
GIMPGLGSPAYAQIFRD

SEQ ID NO: 10207 - protein, 30 aa, Artificial Sequence; identical to SEQ ID NO: 3507
  Description of Artificial Sequence: Synthetic polypeptide

SEQ ID NO: 10208 - protein, 19 aa, Artificial Sequence
  Description of Artificial Sequence: Synthetic peptide
ARDPSILNTGNHHWYDLDI

SEQ ID NO: 10209 - protein, 11 aa, Artificial Sequence
  Description of Artificial Sequence: Synthetic peptide
WGQGTTVTVSS

SEQ ID NO: 10210 - DNA, 378 bp, Artificial Sequence
  Description of Artificial Sequence: Synthetic polynucleotide
caggtccagctggtgcagtctggggctgaggtgaagaagcctgggtcctcggtgaaggtctcctgcaaggcttctggaggcatgttcactgactatgccatcagttgggtgcgacaggcccctggacaacgacttgagtggatgggagggatcatgcctggccttggttcgccagcctacgcacagatttttcgggacagagccaccatttccgcggacgtttccacgagcacggcctacttggaactgaccagcctgaagcctgaggacacggccgtgtattattgtgcgagagacccgtctattcttaacactgggaatcaccactggtatgatttagatatctggggccaagggaccacggtcaccgtctcttca

SEQ ID NO: 10211 - skipped

SEQ ID NO: 10212 - protein, 112 aa, Artificial Sequence
  Description of Artificial Sequence: Synthetic polypeptide
DIQLTQSPLSLPVGLGQSASISCRSSQRVVHTDGNTYLNWYHQRPGQSPRRLIYKVSNRDSGVPDRFSGSGSGTDFTLRISRVEAEDVGVYYCMQSTDWPRTFGQGTKLEIK

SEQ ID NO: 10213 - protein, 23 aa, Artificial Sequence
  Description of Artificial Sequence: Synthetic peptide
DIQLTQSPLSLPVGLGQSASISC

SEQ ID NO: 10214 - protein, 16 aa, Artificial Sequence
  Description of Artificial Sequence: Synthetic peptide
RSSQRVVHTDGNTYLN

SEQ ID NO: 10215 - protein, 15 aa, Artificial Sequence
  Description of Artificial Sequence: Synthetic peptide
WYHQRPGQSPRRLIY

SEQ ID NO: 10216 - protein, 7 aa, Artificial Sequence
  Description of Artificial Sequence: Synthetic peptide
KVSNRDS

SEQ ID NO: 10217 - protein, 32 aa, Artificial Sequence; identical to SEQ ID NO: 3517
  Description of Artificial Sequence: Synthetic polypeptide

SEQ ID NO: 10218 - protein, 9 aa, Artificial Sequence
  Description of Artificial Sequence: Synthetic peptide
MQSTDWPRT

SEQ ID NO: 10219 - protein, 10 aa, Artificial Sequence
  Description of Artificial Sequence: Synthetic peptide
FGQGTKLEIK

SEQ ID NO: 10220 - DNA, 336 bp, Artificial Sequence
  Description of Artificial Sequence: Synthetic polynucleotide
gacatccagttgacccagtctccactctccctgcccgtcggcctcggacagtcggcctccatctcctgcaggtctagtcaaagggtcgtacacactgatggcaacacctacttaaattggtatcaccagaggccaggccaatctccaaggcgcctcatttataaggtttctaaccgggactccggggtcccggacagattcagcggcagtgggtcaggcactgatttcaccctgagaatcagcagggtggaggctgaggatgttggcgtttattactgcatgcaatctacagactggcctcggacgttcggccaagggaccaagctggagatcaaa

SEQ ID NO: 10221-10301 - skipped (81 entries)

SEQ ID NO: 10302 - protein, 126 aa, Artificial Sequence
  Description of Artificial Sequence: Synthetic polypeptide
QVQLVQSGAEVKKPGSSVKVSCKASGGMFTDYAISWVRQAPGQRPEWMGGIMPGLGSPAYAQIFRGRATISADLSTSTAYLELTSLKPEDTAVYYCARDPSILNTGNHHWYDLDIWGQGTMVTVSS

SEQ ID NO: 10303 - protein, 26 aa, Artificial Sequence
  Description of Artificial Sequence: Synthetic peptide
QVQLVQSGAEVKKPGSSVKVSCKASG

SEQ ID NO: 10304 - protein, 9 aa, Artificial Sequence
  Description of Artificial Sequence: Synthetic peptide
GMFTDYAIS

SEQ ID NO: 10305 - protein, 14 aa, Artificial Sequence
  Description of Artificial Sequence: Synthetic peptide
WVRQAPGQRPEWMG

SEQ ID NO: 10306 - protein, 17 aa, Artificial Sequence
  Description of Artificial Sequence: Synthetic peptide
GIMPGLGSPAYAQIFRG

SEQ ID NO: 10307 - protein, 30 aa, Artificial Sequence
  Description of Artificial Sequence: Synthetic polypeptide
RATISADLSTSTAYLELTSLKPEDTAVYYC

SEQ ID NO: 10308 - protein, 19 aa, Artificial Sequence
  Description of Artificial Sequence: Synthetic peptide
ARDPSILNTGNHHWYDLDI

SEQ ID NO: 10309 - protein, 11 aa, Artificial Sequence
  Description of Artificial Sequence: Synthetic peptide
WGQGTMVTVSS

SEQ ID NO: 10310 - DNA, 378 bp, Artificial Sequence
  Description of Artificial Sequence: Synthetic polynucleotide
caggtccagctggtgcagtctggggctgaggtgaagaagcctgggtcctcggtgaaggtctcctgcaaggcttctggaggcatgttcactgactatgccatcagttgggtgcgacaggcccctggacaacgacctgagtggatgggagggatcatgcctggccttggttcgccagcctacgcacagatttttcggggcagagccaccatttccgcggacctttctacgagtacggcctacttggaactgaccagcctgaagcctgaggacacggccgtgtattattgtgcgagagacccgtctattcttaatactgggaatcaccactggtatgatttagatatctggggccaagggacaatggtcaccgtctcttca

SEQ ID NO: 10311 - skipped

SEQ ID NO: 10312 - protein, 112 aa, Artificial Sequence
  Description of Artificial Sequence: Synthetic polypeptide
DIVLTQSPLSLPVGLGQSASISCRSSQRVVHTDGNTYLHWFHQRPGQSPRRLIYKVSNRDSGVPDRFSGSGSGTDFTLRISRVEAEDVGVYYCMQGTEWPRTFGQGTKLEIK

SEQ ID NO: 10313 - protein, 23 aa, Artificial Sequence
  Description of Artificial Sequence: Synthetic peptide
DIVLTQSPLSLPVGLGQSASISC

SEQ ID NO: 10314 - protein, 16 aa, Artificial Sequence
  Description of Artificial Sequence: Synthetic peptide
RSSQRVVHTDGNTYLH

SEQ ID NO: 10315 - protein, 15 aa, Artificial Sequence
  Description of Artificial Sequence: Synthetic peptide
WFHQRPGQSPRRLIY

SEQ ID NO: 10316 - protein, 7 aa, Artificial Sequence
  Description of Artificial Sequence: Synthetic peptide
KVSNRDS

SEQ ID NO: 10317 - protein, 32 aa, Artificial Sequence; identical to SEQ ID NO: 3517
  Description of Artificial Sequence: Synthetic polypeptide

SEQ ID NO: 10318 - protein, 9 aa, Artificial Sequence
  Description of Artificial Sequence: Synthetic peptide
MQGTEWPRT

SEQ ID NO: 10319 - protein, 10 aa, Artificial Sequence
  Description of Artificial Sequence: Synthetic peptide
FGQGTKLEIK

SEQ ID NO: 10320 - DNA, 336 bp, Artificial Sequence
  Description of Artificial Sequence: Synthetic polynucleotide
gatattgtgctgacgcagtctccactctccctgcccgtcggcctcggacagtcggcctccatctcctgcaggtctagtcaaagggtcgtacacactgatgggaacacctacttgcattggtttcaccagaggccaggccaatctccaaggcgcctcatttataaggtttctaaccgggactccggggtcccagacagattcagcggcagtgggtcaggcactgatttcaccctgagaatcagcagggtggaggctgaggatgttggcgtttattactgcatgcaaggtacagagtggcctcggacgttcggccaagggaccaagctggagatcaaa

SEQ ID NO: 10321-10401 - skipped (81 entries)

SEQ ID NO: 10402 - protein, 122 aa, Artificial Sequence
  Description of Artificial Sequence: Synthetic polypeptide
QVTLKESGGGLVQPGGSLRLSCAASGFTVNSYGMSWVRQAPGKGLEWVSGFKSRSDRPDYAESVKGRFTISRDTSKNTVYLEMIGLRAEDTATYYCVRMDWMEWMKYYFDSWGQGALVTVSS

SEQ ID NO: 10403 - protein, 26 aa, Artificial Sequence
  Description of Artificial Sequence: Synthetic peptide
QVTLKESGGGLVQPGGSLRLSCAASG

SEQ ID NO: 10404 - protein, 9 aa, Artificial Sequence
  Description of Artificial Sequence: Synthetic peptide
FTVNSYGMS

SEQ ID NO: 10405 - protein, 14 aa, Artificial Sequence
  Description of Artificial Sequence: Synthetic peptide
WVRQAPGKGLEWVS

SEQ ID NO: 10406 - protein, 17 aa, Artificial Sequence
  Description of Artificial Sequence: Synthetic peptide
GFKSRSDRPDYAESVKG

SEQ ID NO: 10407 - protein, 30 aa, Artificial Sequence
  Description of Artificial Sequence: Synthetic polypeptide
RFTISRDTSKNTVYLEMIGLRAEDTATYYC

SEQ ID NO: 10408 - protein, 15 aa, Artificial Sequence
  Description of Artificial Sequence: Synthetic peptide
VRMDWMEWMKYYFDS

SEQ ID NO: 10409 - protein, 11 aa, Artificial Sequence
  Description of Artificial Sequence: Synthetic peptide
WGQGALVTVSS

SEQ ID NO: 10410 - DNA, 366 bp, Artificial Sequence
  Description of Artificial Sequence: Synthetic polynucleotide
caggtcaccttgaaggagtctgggggaggcttggtccagcctggggggtccctgagactctcctgtgcagcctctggattcaccgttaacagctatggcatgagctgggtccgccaggctccagggaaggggctggagtgggtttcaggttttaagagtcgaagtgataggccagactacgcagagtccgtgaagggccggttcaccatctccagagacacttccaagaacacggtatatctggaaatgataggcctgagagccgaggacacggccacatattactgtgtgagaatggactggatggaatggatgaagtactactttgactcttggggccagggagccctggtcaccgtctcctca

SEQ ID NO: 10411 - skipped

SEQ ID NO: 10412 - protein, 108 aa, Artificial Sequence
  Description of Artificial Sequence: Synthetic polypeptide
ETTLTQSPVTLSVSPGERATLSCRASQSVISNLAWYQQKPGQAPRLLIFGASTRATGVPARFSGSGSGTEFTLTISSLQSEDFAVYYCQQYNNWPSLTFGGGTKLEIK

SEQ ID NO: 10413 - protein, 23 aa, Artificial Sequence
  Description of Artificial Sequence: Synthetic peptide
ETTLTQSPVTLSVSPGERATLSC

SEQ ID NO: 10414 - protein, 11 aa, Artificial Sequence
  Description of Artificial Sequence: Synthetic peptide
RASQSVISNLA

SEQ ID NO: 10415 - protein, 15 aa, Artificial Sequence
  Description of Artificial Sequence: Synthetic peptide
WYQQKPGQAPRLLIF

SEQ ID NO: 10416 - protein, 7 aa, Artificial Sequence
  Description of Artificial Sequence: Synthetic peptide
GASTRAT

SEQ ID NO: 10417 - protein, 32 aa, Artificial Sequence
  Description of Artificial Sequence: Synthetic polypeptide
GVPARFSGSGSGTEFTLTISSLQSEDFAVYYC

SEQ ID NO: 10418 - protein, 10 aa, Artificial Sequence
  Description of Artificial Sequence: Synthetic peptide
QQYNNWPSLT

SEQ ID NO: 10419 - protein, 10 aa, Artificial Sequence
  Description of Artificial Sequence: Synthetic peptide
FGGGTKLEIK

SEQ ID NO: 10420 - DNA, 324 bp, Artificial Sequence
  Description of Artificial Sequence: Synthetic polynucleotide
gaaacgacactcacgcagtctccagtcaccctgtctgtgtctccaggtgaaagagccaccctctcctgcagggccagtcaaagtgttatcagtaacttagcctggtaccagcagaaacctggccaggctcccaggctcctcatctttggtgcctccaccagggccactggtgtcccagccaggttcagtggcagtgggtctgggacagagttcactctcaccatcagcagcctgcagtctgaagattttgcagtttattactgtcagcagtataataactggccctcgctcactttcggcggagggaccaagctggagatcaaa

SEQ ID NO: 10421-10501 - skipped (81 entries)

SEQ ID NO: 10502 - protein, 126 aa, Artificial Sequence
  Description of Artificial Sequence: Synthetic polypeptide
QVQLVQSGAEVKKPGSSVKVSCKASGGMISDYAISWVRQAPGQRLEWMGGIMPAFGSPGYAQIFRGRATISADVSTNTAYLELTSLNPDDTAVYYCARDPSILNTGNHHWYDLDMWGQGTMVTVSS

SEQ ID NO: 10503 - protein, 26 aa, Artificial Sequence
  Description of Artificial Sequence: Synthetic peptide
QVQLVQSGAEVKKPGSSVKVSCKASG

SEQ ID NO: 10504 - protein, 9 aa, Artificial Sequence
  Description of Artificial Sequence: Synthetic peptide
GMISDYAIS

SEQ ID NO: 10505 - protein, 14 aa, Artificial Sequence
  Description of Artificial Sequence: Synthetic peptide
WVRQAPGQRLEWMG

SEQ ID NO: 10506 - protein, 17 aa, Artificial Sequence
  Description of Artificial Sequence: Synthetic peptide
GIMPAFGSPGYAQIFRG

SEQ ID NO: 10507 - protein, 30 aa, Artificial Sequence
  Description of Artificial Sequence: Synthetic polypeptide
RATISADVSTNTAYLELTSLNPDDTAVYYC

SEQ ID NO: 10508 - protein, 19 aa, Artificial Sequence
  Description of Artificial Sequence: Synthetic peptide
ARDPSILNTGNHHWYDLDM

SEQ ID NO: 10509 - protein, 11 aa, Artificial Sequence
  Description of Artificial Sequence: Synthetic peptide
WGQGTMVTVSS

SEQ ID NO: 10510 - DNA, 378 bp, Artificial Sequence
  Description of Artificial Sequence: Synthetic polynucleotide
caggtccagctggtacagtctggggctgaggtgaagaagcctgggtcctcggtgaaggtctcctgcaaggcttctggaggcatgatcagtgactatgccatcagttgggtgcgacaggcccctggacaacgacttgagtggatgggagggatcatgcctgcctttggttcgccaggctacgcacagattttccggggcagagccaccatttccgcggacgtatccacgaacacggcctacttggaactgaccagcctgaaccctgacgacacggccgtatattattgtgcgagagacccgtctattcttaacactgggaatcaccactggtatgatttagatatgtggggccaagggacaatggtcaccgtctcctca

SEQ ID NO: 10511 - skipped

SEQ ID NO: 10512 - protein, 112 aa, Artificial Sequence
  Description of Artificial Sequence: Synthetic polypeptide
DIQVTQSPLSLPVGLGQSASISCRSSQRVVHTDGNTYLNWFHQRPGQSPRRLIYKVSNRDSGVPDRFSGSGSGTDFTLRISRVEAEDVGVYYCMQATEWPRTFGQGTKVDIK

SEQ ID NO: 10513 - protein, 23 aa, Artificial Sequence
  Description of Artificial Sequence: Synthetic peptide
DIQVTQSPLSLPVGLGQSASISC

SEQ ID NO: 10514 - protein, 16 aa, Artificial Sequence
  Description of Artificial Sequence: Synthetic peptide
RSSQRVVHTDGNTYLN

SEQ ID NO: 10515 - protein, 15 aa, Artificial Sequence
  Description of Artificial Sequence: Synthetic peptide
WFHQRPGQSPRRLIY

SEQ ID NO: 10516 - protein, 7 aa, Artificial Sequence
  Description of Artificial Sequence: Synthetic peptide
KVSNRDS

SEQ ID NO: 10517 - protein, 32 aa, Artificial Sequence; identical to SEQ ID NO: 3517
  Description of Artificial Sequence: Synthetic polypeptide

SEQ ID NO: 10518 - protein, 9 aa, Artificial Sequence
  Description of Artificial Sequence: Synthetic peptide
MQATEWPRT

SEQ ID NO: 10519 - protein, 10 aa, Artificial Sequence
  Description of Artificial Sequence: Synthetic peptide
FGQGTKVDIK

SEQ ID NO: 10520 - DNA, 336 bp, Artificial Sequence
  Description of Artificial Sequence: Synthetic polynucleotide
gacatccaggtgacccagtctccactctccctgcccgtcggcctcggacagtcggcctccatctcctgcaggtctagtcaaagggtcgtacacactgatgggaacacctacttgaattggtttcaccagaggccaggccaatctccaaggcgcctcatttataaggtttctaaccgggactccggggtcccagacagattcagcggcagtgggtcaggcactgatttcaccctgagaatcagcagggtggaggctgaggatgttggcgtttattactgcatgcaagctacagagtggcctcggacgttcggccaagggaccaaagtggatatcaaa

SEQ ID NO: 10521-10601 - skipped (81 entries)

SEQ ID NO: 10602 - protein, 127 aa, Artificial Sequence
  Description of Artificial Sequence: Synthetic polypeptide
QVQLVESGGSVVQPGTSLKLSCAGSAGLTITRYAMHWVRQAPGKGLEWVALVSHDGIHIGYSDSVRGRFTISRDNSRNTLYLQMDGLRPEDTAVYYCVRDDVLQHSRPSGPGYFVSWGQGTLVTVSS

SEQ ID NO: 10603 - protein, 27 aa, Artificial Sequence
  Description of Artificial Sequence: Synthetic peptide
QVQLVESGGSVVQPGTSLKLSCAGSAG

SEQ ID NO: 10604 - protein, 9 aa, Artificial Sequence
  Description of Artificial Sequence: Synthetic peptide
LTITRYAMH

SEQ ID NO: 10605 - protein, 14 aa, Artificial Sequence
  Description of Artificial Sequence: Synthetic peptide
WVRQAPGKGLEWVA

SEQ ID NO: 10606 - protein, 17 aa, Artificial Sequence
  Description of Artificial Sequence: Synthetic peptide
LVSHDGIHIGYSDSVRG

SEQ ID NO: 10607 - protein, 30 aa, Artificial Sequence; identical to SEQ ID NO: 9407
  Description of Artificial Sequence: Synthetic polypeptide

SEQ ID NO: 10608 - protein, 19 aa, Artificial Sequence
  Description of Artificial Sequence: Synthetic peptide
VRDDVLQHSRPSGPGYFVS

SEQ ID NO: 10609 - protein, 11 aa, Artificial Sequence
  Description of Artificial Sequence: Synthetic peptide
WGQGTLVTVSS

SEQ ID NO: 10610 - DNA, 381 bp, Artificial Sequence
  Description of Artificial Sequence: Synthetic polynucleotide
caggtgcagctggtggagtctgggggctccgttgtccagcctgggacgtccctgaaactctcctgtgcagggtccgctggactcactatcactcgctatgctatgcactgggtccgccaggctccaggcaaaggcctggagtgggtggctcttgtgtcacatgatggcatccacataggatattcagactccgtgaggggccgattcaccatctccagagacaactccaggaacacactgtatctccaaatggacggcctgagacctgaagacacggctgtctattactgtgtaagagatgacgtattacagcactctcggccctctgggcccggatactttgtctcgtggggccagggaaccctggtcaccgtctcttca

SEQ ID NO: 10611 - skipped

SEQ ID NO: 10612 - protein, 106 aa, Artificial Sequence
  Description of Artificial Sequence: Synthetic polypeptide
EIVMTQSPATLSLSPGERATLSCRASQSVSTFLGWYQQRPGQPPRLLIYDASYRAPDIPVRFSGSGSGTDFTLTINSLEPEDSAVYYCQQRSDGYNFGPGTKLEIK

SEQ ID NO: 10613 - protein, 23 aa, Artificial Sequence
  Description of Artificial Sequence: Synthetic peptide
EIVMTQSPATLSLSPGERATLSC

SEQ ID NO: 10614 - protein, 11 aa, Artificial Sequence
  Description of Artificial Sequence: Synthetic peptide
RASQSVSTFLG

SEQ ID NO: 10615 - protein, 15 aa, Artificial Sequence
  Description of Artificial Sequence: Synthetic peptide
WYQQRPGQPPRLLIY

SEQ ID NO: 10616 - protein, 7 aa, Artificial Sequence
  Description of Artificial Sequence: Synthetic peptide
DASYRAP

SEQ ID NO: 10617 - protein, 32 aa, Artificial Sequence; identical to SEQ ID NO: 9417
  Description of Artificial Sequence: Synthetic polypeptide

SEQ ID NO: 10618 - protein, 8 aa, Artificial Sequence
  Description of Artificial Sequence: Synthetic peptide
QQRSDGYN

SEQ ID NO: 10619 - protein, 10 aa, Artificial Sequence
  Description of Artificial Sequence: Synthetic peptide
FGPGTKLEIK

SEQ ID NO: 10620 - DNA, 318 bp, Artificial Sequence
  Description of Artificial Sequence: Synthetic polynucleotide
gaaattgtgatgacacagtctccagccaccctgtctttgtctccaggggaaagggccaccctctcctgcagggccagtcagagtgttagcaccttcttaggctggtaccaacagagacctggccagcctcccaggctcctcatttatgatgcatcctacagggcccctgacatcccagtcagattcagtggcagtgggtctgggacagacttcactctcaccatcaacagcctagagcctgaagattctgcagtttactactgtcagcagcgtagtgacgggtacaattttggcccggggaccaagctggagatcaaa

SEQ ID NO: 10621-10701 - skipped (81 entries)

SEQ ID NO: 10702 - protein, 127 aa, Artificial Sequence; identical to SEQ ID NO: 7602
  Description of Artificial Sequence: Synthetic polypeptide

SEQ ID NO: 10703 - protein, 26 aa, Artificial Sequence
  Description of Artificial Sequence: Synthetic peptide
QVQLQESGPGLVKPSGTLSLTCAVSG

SEQ ID NO: 10704 - protein, 10 aa, Artificial Sequence
  Description of Artificial Sequence: Synthetic peptide
ASVSSDHWWS

SEQ ID NO: 10705 - protein, 14 aa, Artificial Sequence
  Description of Artificial Sequence: Synthetic peptide
WVRQSPGKGLEWIG

SEQ ID NO: 10706 - protein, 16 aa, Artificial Sequence
  Description of Artificial Sequence: Synthetic peptide
EVYHSGSTNYNPSLKS

SEQ ID NO: 10707 - protein, 30 aa, Artificial Sequence; identical to SEQ ID NO: 7407
  Description of Artificial Sequence: Synthetic polypeptide

SEQ ID NO: 10708 - protein, 20 aa, Artificial Sequence
  Description of Artificial Sequence: Synthetic peptide
ATMWGGLCTASNCYGNPMDV

SEQ ID NO: 10709 - protein, 11 aa, Artificial Sequence
  Description of Artificial Sequence: Synthetic peptide
WGQGTTVTVSS

SEQ ID NO: 10710 - DNA, 381 bp, Artificial Sequence
  Description of Artificial Sequence: Synthetic polynucleotide
caggtgcagctgcaggagtcgggcccaggactggtgaagccttcggggaccctgtccctcacctgcgctgtctccggtgcctccgtcagtagtgatcactggtggagttgggtccgccagtccccagggaagggcctggagtggattggcgaagtctatcatagtgggagcaccaactacaacccgtccctcaagagtcgagtcaccatatcactagaccagtccaataaccagttctccctgaagttgacctctgtgaccgccgcggacacggccatatattactgtgcgacaatgtggggcggactctgtactgctagcaactgctatggcaaccctatggacgtctggggccaagggaccacggtcaccgtctcttca

SEQ ID NO: 10711 - skipped

SEQ ID NO: 10712 - protein, 108 aa, Artificial Sequence
  Description of Artificial Sequence: Synthetic polypeptide
QPVLTQPPSVSVSPGQTARITCSGDALPRRYAYWYQQRSGQAPVLVIYEDNKRPSGIPERFSAFSSGTRATLTISGAQVEDQADYYCYSTDSTANYKVFGGGTKLTVL

SEQ ID NO: 10713 - protein, 22 aa, Artificial Sequence
  Description of Artificial Sequence: Synthetic peptide
QPVLTQPPSVSVSPGQTARITC

SEQ ID NO: 10714 - protein, 11 aa, Artificial Sequence
  Description of Artificial Sequence: Synthetic peptide
SGDALPRRYAY

SEQ ID NO: 10715 - protein, 15 aa, Artificial Sequence
  Description of Artificial Sequence: Synthetic peptide
WYQQRSGQAPVLVIY

SEQ ID NO: 10716 - protein, 7 aa, Artificial Sequence
  Description of Artificial Sequence: Synthetic peptide
EDNKRPS

SEQ ID NO: 10717 - protein, 32 aa, Artificial Sequence
  Description of Artificial Sequence: Synthetic polypeptide
GIPERFSAFSSGTRATLTISGAQVEDQADYYC

SEQ ID NO: 10718 - protein, 11 aa, Artificial Sequence
  Description of Artificial Sequence: Synthetic peptide
YSTDSTANYKV

SEQ ID NO: 10719 - protein, 10 aa, Artificial Sequence
  Description of Artificial Sequence: Synthetic peptide
FGGGTKLTVL

SEQ ID NO: 10720 - DNA, 324 bp, Artificial Sequence
  Description of Artificial Sequence: Synthetic polynucleotide
cagcctgtgctgacacagccaccctcggtgtcagtgtccccaggacaaacggccaggatcacctgctctggagatgcattgcctagaagatatgcctattggtaccagcagaggtcaggccaggcccctgtgttggtcatctatgaagacaataaacgaccctccgggatccctgagagattctctgccttcagctcagggacaagggccaccttgactatcagtggggcccaggtagaggatcaagctgactactactgttactcaacagacagcactgccaattataaggtgtttggcggagggaccaagctgaccgtccta

SEQ ID NO: 10721-10801 - skipped (81 entries)

SEQ ID NO: 10802 - protein, 123 aa, Artificial Sequence
  Description of Artificial Sequence: Synthetic polypeptide
EVQLVESGGGVVQPGRSLRLSCVTSGFDFRPYAMQWVRQAPGKGLEWVAVISHDGVHTGYADSLKGRFTISRDNSKNTLYLQVDSLRPDDSALYYCARDNALQNAQIGYLDYWGQGTLVTVSS

SEQ ID NO: 10803 - protein, 26 aa, Artificial Sequence
  Description of Artificial Sequence: Synthetic peptide
EVQLVESGGGVVQPGRSLRLSCVTSG

SEQ ID NO: 10804 - protein, 9 aa, Artificial Sequence
  Description of Artificial Sequence: Synthetic peptide
FDFRPYAMQ

SEQ ID NO: 10805 - protein, 14 aa, Artificial Sequence
  Description of Artificial Sequence: Synthetic peptide
WVRQAPGKGLEWVA

SEQ ID NO: 10806 - protein, 17 aa, Artificial Sequence
  Description of Artificial Sequence: Synthetic peptide
VISHDGVHTGYADSLKG

SEQ ID NO: 10807 - protein, 30 aa, Artificial Sequence
  Description of Artificial Sequence: Synthetic polypeptide
RFTISRDNSKNTLYLQVDSLRPDDSALYYC

SEQ ID NO: 10808 - protein, 16 aa, Artificial Sequence
  Description of Artificial Sequence: Synthetic peptide
ARDNALQNAQIGYLDY

SEQ ID NO: 10809 - protein, 11 aa, Artificial Sequence
  Description of Artificial Sequence: Synthetic peptide
WGQGTLVTVSS

SEQ ID NO: 10810 - DNA, 369 bp, Artificial Sequence
  Description of Artificial Sequence: Synthetic polynucleotide
gaggtgcagctggtggagtctgggggaggcgtggtccagcctgggaggtcgctgagactctcctgtgtcacgtctggattcgacttcaggccatatgctatgcagtgggtccgccaggctccaggcaaggggctggagtgggtggcagttatttcacatgatggagtccacacaggctacgcagactccctgaagggccgattcaccatctccagagacaattccaagaacacgctctatttgcaagtggacagcctgagacctgacgactcggctctctattactgtgcgagagataacgcactgcagaatgctcaaattggataccttgactactggggccagggaaccctggtcaccgtctcctca

SEQ ID NO: 10811 - skipped

SEQ ID NO: 10812 - protein, 106 aa, Artificial Sequence
  Description of Artificial Sequence: Synthetic polypeptide
EIVMTQSPATLSVSPGETATLSCRASQSVGRFMGWYQQKPGQAPRLLIFDASNRVTGVPDRFRGSGSGTDFILTINSLEPEDSASYYCQRRGDGYNFGQGTKVEIK

SEQ ID NO: 10813 - protein, 23 aa, Artificial Sequence
  Description of Artificial Sequence: Synthetic peptide
EIVMTQSPATLSVSPGETATLSC

SEQ ID NO: 10814 - protein, 11 aa, Artificial Sequence
  Description of Artificial Sequence: Synthetic peptide
RASQSVGRFMG

SEQ ID NO: 10815 - protein, 15 aa, Artificial Sequence
  Description of Artificial Sequence: Synthetic peptide
WYQQKPGQAPRLLIF

SEQ ID NO: 10816 - protein, 7 aa, Artificial Sequence
  Description of Artificial Sequence: Synthetic peptide
DASNRVT

SEQ ID NO: 10817 - protein, 32 aa, Artificial Sequence
  Description of Artificial Sequence: Synthetic polypeptide
GVPDRFRGSGSGTDFILTINSLEPEDSASYYC

SEQ ID NO: 10818 - protein, 8 aa, Artificial Sequence
  Description of Artificial Sequence: Synthetic peptide
QRRGDGYN

SEQ ID NO: 10819 - protein, 10 aa, Artificial Sequence
  Description of Artificial Sequence: Synthetic peptide
FGQGTKVEIK

SEQ ID NO: 10820 - DNA, 318 bp, Artificial Sequence
  Description of Artificial Sequence: Synthetic polynucleotide
gaaattgtgatgacgcagtctccagccacactgtctgtgtctccaggggaaacagccaccctctcctgcagggccagtcagagtgttggaaggttcatgggttggtatcaacagaaacctggccaggctcccaggctcctcatttttgatgcatcgaatagggtcactggcgtcccagacaggttccgtggcagtgggtctgggacagacttcattctcaccatcaacagcctagagcctgaagattctgcaagttattactgtcagcgccgtggcgacgggtacaattttggccaggggaccaaggtggaaatcaaa

SEQ ID NO: 10821-10901 - skipped (81 entries)

SEQ ID NO: 10902 - protein, 129 aa, Artificial Sequence
  Description of Artificial Sequence: Synthetic polypeptide
QVQLVQSGAEVRKPGSSVKLSCKASGGIFSTHAISWVRQAPGQRPEWMGGIIPIFGESKDTRKFQGRVTFTADESTTTAYMELRSLKSDDTAIYYCVLDSDPYTATFSHNHYWYAMDVWGQGTTVTVSS

SEQ ID NO: 10903 - protein, 26 aa, Artificial Sequence
  Description of Artificial Sequence: Synthetic peptide
QVQLVQSGAEVRKPGSSVKLSCKASG

SEQ ID NO: 10904 - protein, 9 aa, Artificial Sequence
  Description of Artificial Sequence: Synthetic peptide
GIFSTHAIS

SEQ ID NO: 10905 - protein, 14 aa, Artificial Sequence
  Description of Artificial Sequence: Synthetic peptide
WVRQAPGQRPEWMG

SEQ ID NO: 10906 - protein, 17 aa, Artificial Sequence
  Description of Artificial Sequence: Synthetic peptide
GIIPIFGESKDTRKFQG

SEQ ID NO: 10907 - protein, 30 aa, Artificial Sequence; identical to SEQ ID NO: 2507
  Description of Artificial Sequence: Synthetic polypeptide

SEQ ID NO: 10908 - protein, 22 aa, Artificial Sequence
  Description of Artificial Sequence: Synthetic peptide
VLDSDPYTATFSHNHYWYAMDV

SEQ ID NO: 10909 - protein, 11 aa, Artificial Sequence
  Description of Artificial Sequence: Synthetic peptide
WGQGTTVTVSS

SEQ ID NO: 10910 - DNA, 387 bp, Artificial Sequence
  Description of Artificial Sequence: Synthetic polynucleotide
caggtccagcttgtacagtctggggctgaggtgaggaagcctgggtcctcggtgaagctctcctgcaaggcttctggaggcatcttcagcacacatgctatcagttgggtgcggcaggcccctggacaacggcctgagtggatgggagggatcatacctatttttggtgagtcaaaagacacacggaagtttcaaggcagagtcacctttaccgcggacgaatccacgacaacagcctacatggagttgaggagcctaaaatctgacgacacggccatatattattgtgtgttagactctgacccctacacggcgacttttagccataatcactattggtatgctatggacgtctggggccaggggaccacggtcactgtctcctca

SEQ ID NO: 10911 - skipped

SEQ ID NO: 10912 - protein, 112 aa, Artificial Sequence
  Description of Artificial Sequence: Synthetic polypeptide
ETTLTQSPLSLPVTLGQPASISCRSSQGLVHSDGNTYLNWFQQRPGQSPRRLIYKVSNRDSGVPDRFSGSGSGTDFTLKISRVEAEDIGVYYCMQGTEWPRTFGQGTKVEIK

SEQ ID NO: 10913 - protein, 23 aa, Artificial Sequence
  Description of Artificial Sequence: Synthetic peptide
ETTLTQSPLSLPVTLGQPASISC

SEQ ID NO: 10914 - protein, 16 aa, Artificial Sequence
  Description of Artificial Sequence: Synthetic peptide
RSSQGLVHSDGNTYLN

SEQ ID NO: 10915 - protein, 15 aa, Artificial Sequence
  Description of Artificial Sequence: Synthetic peptide
WFQQRPGQSPRRLIY

SEQ ID NO: 10916 - protein, 7 aa, Artificial Sequence
  Description of Artificial Sequence: Synthetic peptide
KVSNRDS

SEQ ID NO: 10917 - protein, 32 aa, Artificial Sequence; identical to SEQ ID NO: 1317
  Description of Artificial Sequence: Synthetic polypeptide

SEQ ID NO: 10918 - protein, 9 aa, Artificial Sequence
  Description of Artificial Sequence: Synthetic peptide
MQGTEWPRT

SEQ ID NO: 10919 - protein, 10 aa, Artificial Sequence
  Description of Artificial Sequence: Synthetic peptide
FGQGTKVEIK

SEQ ID NO: 10920 - DNA, 336 bp, Artificial Sequence
  Description of Artificial Sequence: Synthetic polynucleotide
gaaacgacactcacgcagtctccactctccctgcccgtcacccttggacagccggcctccatctcctgcaggtctagtcaaggcctcgtacacagtgatggaaacacctacttgaattggtttcagcagaggccaggccaatctccaaggcgcctcatttataaggtttctaaccgggactctggggtcccagacagattcagcggcagtgggtcaggcactgacttcacactgaaaatcagcagggtggaggctgaggatattggagtttattattgcatgcaaggtacagagtggcctcggacttttggccaggggaccaaggtggaaatcaaa

SEQ ID NO: 10921-11001 - skipped (81 entries)

SEQ ID NO: 11002 - protein, 126 aa, Artificial Sequence; identical to SEQ ID NO: 1502
  Description of Artificial Sequence: Synthetic polypeptide

SEQ ID NO: 11003 - protein, 26 aa, Artificial Sequence
  Description of Artificial Sequence: Synthetic peptide
QVQLVQSGAELKKPGSSVRVSCKAAG

SEQ ID NO: 11004 - protein, 9 aa, Artificial Sequence
  Description of Artificial Sequence: Synthetic peptide
GTLTNYAIS

SEQ ID NO: 11005 - protein, 14 aa, Artificial Sequence
  Description of Artificial Sequence: Synthetic peptide
WVRQAPGQGFEWMG

SEQ ID NO: 11006 - protein, 17 aa, Artificial Sequence
  Description of Artificial Sequence: Synthetic peptide
GIMPVSHTAGYAQKFQG

SEQ ID NO: 11007 - protein, 30 aa, Artificial Sequence; identical to SEQ ID NO: 1507
  Description of Artificial Sequence: Synthetic polypeptide

SEQ ID NO: 11008 - protein, 19 aa, Artificial Sequence
  Description of Artificial Sequence: Synthetic peptide
ARDPSIHYTGNHHWYDLDI

SEQ ID NO: 11009 - protein, 11 aa, Artificial Sequence
  Description of Artificial Sequence: Synthetic peptide
WGQGTTVTVSS

SEQ ID NO: 11010 - DNA, 378 bp, Artificial Sequence
  Description of Artificial Sequence: Synthetic polynucleotide
caggtccagcttgtacagtctggggctgagttgaagaagcctgggtcgtcggtgagggtctcctgcaaggcggctggaggcaccctcactaattatgccataagttgggtgcgacaggcccctggacaagggtttgagtggatgggagggatcatgcctgtctctcatacggcaggctacgcacagaaatttcagggccgagtcacctttaccgcggacgaatccgcgaccacagcctacatggacctaacgagcctgagacctgaggacacggccatatattactgtgccagagatccgtctattcattacactgggaatcaccattggtatgatttagatatctggggccaagggaccacggtcaccgtctcctca

SEQ ID NO: 11011 - skipped

SEQ ID NO: 11012 - protein, 112 aa, Artificial Sequence
  Description of Artificial Sequence: Synthetic polypeptide
DIRVTQSPLSLPVTLGQPASISCRSSQRIVHTDGNTYLNWFLQRPGQSPRRLIYKVSNRDSGVPDRFSGSGSGTDFTLKISRVEAEDVGIYYCMQGTEWPRTFGQGTKVDIK

SEQ ID NO: 11013 - protein, 23 aa, Artificial Sequence
  Description of Artificial Sequence: Synthetic peptide
DIRVTQSPLSLPVTLGQPASISC

SEQ ID NO: 11014 - protein, 16 aa, Artificial Sequence
  Description of Artificial Sequence: Synthetic peptide
RSSQRIVHTDGNTYLN

SEQ ID NO: 11015 - protein, 15 aa, Artificial Sequence
  Description of Artificial Sequence: Synthetic peptide
WFLQRPGQSPRRLIY

SEQ ID NO: 11016 - protein, 7 aa, Artificial Sequence
  Description of Artificial Sequence: Synthetic peptide
KVSNRDS

SEQ ID NO: 11017 - protein, 32 aa, Artificial Sequence; identical to SEQ ID NO: 1517
  Description of Artificial Sequence: Synthetic polypeptide

SEQ ID NO: 11018 - protein, 9 aa, Artificial Sequence
  Description of Artificial Sequence: Synthetic peptide
MQGTEWPRT

SEQ ID NO: 11019 - protein, 10 aa, Artificial Sequence
  Description of Artificial Sequence: Synthetic peptide
FGQGTKVDIK

SEQ ID NO: 11020 - DNA, 336 bp, Artificial Sequence
  Description of Artificial Sequence: Synthetic polynucleotide
gacatccgggtgacccagtctccactctccctgcccgtcacccttggccagccggcctccatctcctgcaggtctagtcaaagaatcgtccacactgatggaaacacctacttgaattggtttctgcagaggccaggccaatctccaaggcgcctaatttataaggtctctaaccgggactccggggtcccagacagattcagcggcagtgggtcaggcactgatttcacactgaaaatcagcagggtggaggctgaggatgttggaatttattactgcatgcaaggtacagagtggcctcggacgttcggccaagggaccaaagtggatatcaaa

SEQ ID NO: 11021-11101 - skipped (81 entries)

SEQ ID NO: 11102 - protein, 124 aa, Artificial Sequence
  Description of Artificial Sequence: Synthetic polypeptide
QVQLVQSGSELKKPGASVKVSCKASGYTFSNYAMNWVRQAPGQGPEWMGWIDTNTGNPTYAQGFIGRFVFSLDTSVNTAYLLIGSLEAEDTAVYYCAREEHYDFSSGYFRPAYWGQGTLVTVSS

SEQ ID NO: 11103 - protein, 26 aa, Artificial Sequence
  Description of Artificial Sequence: Synthetic peptide
QVQLVQSGSELKKPGASVKVSCKASG

SEQ ID NO: 11104 - protein, 9 aa, Artificial Sequence
  Description of Artificial Sequence: Synthetic peptide
YTFSNYAMN

SEQ ID NO: 11105 - protein, 14 aa, Artificial Sequence
  Description of Artificial Sequence: Synthetic peptide
WVRQAPGQGPEWMG

SEQ ID NO: 11106 - protein, 17 aa, Artificial Sequence
  Description of Artificial Sequence: Synthetic peptide
WIDTNTGNPTYAQGFIG

SEQ ID NO: 11107 - protein, 30 aa, Artificial Sequence
  Description of Artificial Sequence: Synthetic polypeptide
RFVFSLDTSVNTAYLLIGSLEAEDTAVYYC

SEQ ID NO: 11108 - protein, 17 aa, Artificial Sequence
  Description of Artificial Sequence: Synthetic peptide
AREEHYDFSSGYFRPAY

SEQ ID NO: 11109 - protein, 11 aa, Artificial Sequence
  Description of Artificial Sequence: Synthetic peptide
WGQGTLVTVSS

SEQ ID NO: 11110 - DNA, 372 bp, Artificial Sequence
  Description of Artificial Sequence: Synthetic polynucleotide
caggtccagctggtgcagtctgggtctgagttgaagaagcctggggcctcagtgaaggtttcctgcaaggcttctggatacaccttcagtaactatgccatgaattgggtgcgacaggcccctggacaagggcctgagtggatggggtggatcgacaccaacactgggaacccaacgtatgcccagggcttcatagggcggtttgtcttctccttggacacctctgtcaacacggcatatctgctgatcggcagcctagaggctgaggacactgccgtctattactgtgcaagggaggaacactacgatttttcgagtggttattttcgccccgcctactggggccagggaaccctggtcaccgtctcttca

SEQ ID NO: 11111 - skipped

SEQ ID NO: 11112 - protein, 107 aa, Artificial Sequence
  Description of Artificial Sequence: Synthetic polypeptide
EIVMTQSPSSLSASVGDRVTITCRAGHTISTYLNWYQQKPGKAPKILISGASSLQSGVPSRFSGSGSGTDFTLTIGSLQPEDFATYYCQQSYSTPYTFGQGTKVDIK

SEQ ID NO: 11113 - protein, 23 aa, Artificial Sequence
  Description of Artificial Sequence: Synthetic peptide
EIVMTQSPSSLSASVGDRVTITC

SEQ ID NO: 11114 - protein, 11 aa, Artificial Sequence
  Description of Artificial Sequence: Synthetic peptide
RAGHTISTYLN

SEQ ID NO: 11115 - protein, 15 aa, Artificial Sequence
  Description of Artificial Sequence: Synthetic peptide
WYQQKPGKAPKILIS

SEQ ID NO: 11116 - protein, 7 aa, Artificial Sequence
  Description of Artificial Sequence: Synthetic peptide
GASSLQS

SEQ ID NO: 11117 - protein, 32 aa, Artificial Sequence
  Description of Artificial Sequence: Synthetic polypeptide
GVPSRFSGSGSGTDFTLTIGSLQPEDFATYYC

SEQ ID NO: 11118 - protein, 9 aa, Artificial Sequence
  Description of Artificial Sequence: Synthetic peptide
QQSYSTPYT

SEQ ID NO: 11119 - protein, 10 aa, Artificial Sequence
  Description of Artificial Sequence: Synthetic peptide
FGQGTKVDIK

SEQ ID NO: 11120 - DNA, 321 bp, Artificial Sequence
  Description of Artificial Sequence: Synthetic polynucleotide
gaaattgtaatgacgcagtctccatcctccctgtctgcatctgtaggagacagggtcaccatcacttgccgggcaggtcacaccattagcacctatttaaattggtatcaacaaaaaccagggaaagcccctaagatcctgatctctggtgcatccagtttgcagagtggggtcccatcaaggtttagtggcagtggatctgggacagatttcactctcaccatcggcagtctgcaacctgaagattttgcaacttactactgtcaacagagttacagtactccgtacacttttggccaggggaccaaagtggatatcaaa

SEQ ID NO: 11121-11201 - skipped (81 entries)

SEQ ID NO: 11202 - protein, 129 aa, Artificial Sequence
  Description of Artificial Sequence: Synthetic polypeptide
QVQLQQWGAGLLKPSETLSLICDVYGGSFNGFYWSWIRQPPGKGLEWIGEISHDGSTNYSPSLKSRVSISIDTSKKQFSLKLRSVTAADTAMYYCARGMTSPVVHLYSSGRPSRWFDFWGQGTLVTVSS

SEQ ID NO: 11203 - protein, 26 aa, Artificial Sequence
  Description of Artificial Sequence: Synthetic peptide
QVQLQQWGAGLLKPSETLSLICDVYG

SEQ ID NO: 11204 - protein, 9 aa, Artificial Sequence
  Description of Artificial Sequence: Synthetic peptide
GSFNGFYWS

SEQ ID NO: 11205 - protein, 14 aa, Artificial Sequence
  Description of Artificial Sequence: Synthetic peptide
WIRQPPGKGLEWIG

SEQ ID NO: 11206 - protein, 16 aa, Artificial Sequence
  Description of Artificial Sequence: Synthetic peptide
EISHDGSTNYSPSLKS

SEQ ID NO: 11207 - protein, 30 aa, Artificial Sequence
  Description of Artificial Sequence: Synthetic polypeptide
RVSISIDTSKKQFSLKLRSVTAADTAMYYC

SEQ ID NO: 11208 - protein, 23 aa, Artificial Sequence
  Description of Artificial Sequence: Synthetic peptide
ARGMTSPVVHLYSSGRPSRWFDF

SEQ ID NO: 11209 - protein, 11 aa, Artificial Sequence
  Description of Artificial Sequence: Synthetic peptide
WGQGTLVTVSS

SEQ ID NO: 11210 - DNA, 387 bp, Artificial Sequence
  Description of Artificial Sequence: Synthetic polynucleotide
caggtgcagctacagcagtggggcgcaggactgttgaagccttcggagaccctgtccctcatttgcgatgtctatggtgggtccttcaatggtttctactggagttggatccgccagccccccgggaagggtctggagtggattggggaaatcagtcatgatggaagcaccaactacagtccgtccctcaagagccgagtctccatttcaattgacacgtccaagaagcagttctccctgaagctgaggtctgtgaccgccgcggacacggctatgtactattgtgcgagaggcatgaccagtccggtggtgcatttatacagtagtggtcgtccctctcgatggttcgacttctggggccagggaaccctggtcactgtctcctca

SEQ ID NO: 11211 - skipped

SEQ ID NO: 11212 - protein, 110 aa, Artificial Sequence
  Description of Artificial Sequence: Synthetic polypeptide
QPVLTQPASVSGSPGQSSTLSCSGTSSDVGSYDLVSWYQQHPGKAPKLMIYEGTKRPSGVSDRFSGSTSGNTASLTISGLQAEDEANYYCCSYAGSGTWIFGGGTKLTVL

SEQ ID NO: 11213 - protein, 22 aa, Artificial Sequence
  Description of Artificial Sequence: Synthetic peptide
QPVLTQPASVSGSPGQSSTLSC

SEQ ID NO: 11214 - protein, 14 aa, Artificial Sequence
  Description of Artificial Sequence: Synthetic peptide
SGTSSDVGSYDLVS

SEQ ID NO: 11215 - protein, 15 aa, Artificial Sequence
  Description of Artificial Sequence: Synthetic peptide
WYQQHPGKAPKLMIY

SEQ ID NO: 11216 - protein, 7 aa, Artificial Sequence
  Description of Artificial Sequence: Synthetic peptide
EGTKRPS

SEQ ID NO: 11217 - protein, 32 aa, Artificial Sequence
  Description of Artificial Sequence: Synthetic polypeptide
GVSDRFSGSTSGNTASLTISGLQAEDEANYYC

SEQ ID NO: 11218 - protein, 10 aa, Artificial Sequence
  Description of Artificial Sequence: Synthetic peptide
CSYAGSGTWI

SEQ ID NO: 11219 - protein, 10 aa, Artificial Sequence
  Description of Artificial Sequence: Synthetic peptide
FGGGTKLTVL

SEQ ID NO: 11220 - DNA, 330 bp, Artificial Sequence
  Description of Artificial Sequence: Synthetic polynucleotide
cagcctgtgctgactcagcctgcctccgtgtctgggtctcctggacagtcgagcaccctctcctgctctggaaccagtagtgatgttgggagttatgaccttgtctcatggtaccaacaacatccaggcaaggcccccaaactcatgatttatgagggcactaagcgaccctcaggggtttctgatcgtttctctggctccacgtctggcaacacggcctccctgacaatctctgggctccaggctgaggacgaggctaattattactgctgctcatatgcaggtagtggcacttggatattcggcggagggaccaagctgaccgtcctc

SEQ ID NO: 11221-11301 - skipped (81 entries)

SEQ ID NO: 11302 - protein, 127 aa, Artificial Sequence
  Description of Artificial Sequence: Synthetic polypeptide
QVQLQESGPGLLKPSETLSLTCTVSNSPISSNYWSWIRQPAGKGLEWIGRIDITGNTNYNPSLKSRVIMSVDTSKSQFSLKMTSVTAADTAVYYCARSFISFDSSGHPYYYYAMDVWGQGTTVTVSS

SEQ ID NO: 11303 - protein, 26 aa, Artificial Sequence
  Description of Artificial Sequence: Synthetic peptide
QVQLQESGPGLLKPSETLSLTCTVSN

SEQ ID NO: 11304 - protein, 9 aa, Artificial Sequence
  Description of Artificial Sequence: Synthetic peptide
SPISSNYWS

SEQ ID NO: 11305 - protein, 14 aa, Artificial Sequence
  Description of Artificial Sequence: Synthetic peptide
WIRQPAGKGLEWIG

SEQ ID NO: 11306 - protein, 16 aa, Artificial Sequence
  Description of Artificial Sequence: Synthetic peptide
RIDITGNTNYNPSLKS

SEQ ID NO: 11307 - protein, 30 aa, Artificial Sequence
  Description of Artificial Sequence: Synthetic polypeptide
RVIMSVDTSKSQFSLKMTSVTAADTAVYYC

SEQ ID NO: 11308 - protein, 21 aa, Artificial Sequence
  Description of Artificial Sequence: Synthetic peptide
ARSFISFDSSGHPYYYYAMDV

SEQ ID NO: 11309 - protein, 11 aa, Artificial Sequence
  Description of Artificial Sequence: Synthetic peptide
WGQGTTVTVSS

SEQ ID NO: 11310 - DNA, 381 bp, Artificial Sequence
  Description of Artificial Sequence: Synthetic polynucleotide
caggtgcagctgcaggagtcgggcccaggactgctgaagccctcggagaccctgtccctcacctgcactgtctctaatagccccatcagtagtaactactggagctggatccggcagcccgccgggaagggactggagtggattgggcgtattgatattactgggaacaccaactacaacccctccctcaagagtcgagtcatcatgtcagtagacacctccaagagccagttctccctgaagatgacctctgtgaccgccgcggacacggccgtgtattactgcgcgagaagttttatctcttttgatagtagtggtcatccctactattactacgccatggacgtctggggccaagggaccacggtcaccgtctcctca

SEQ ID NO: 11311 - skipped

SEQ ID NO: 11312 - protein, 108 aa, Artificial Sequence
  Description of Artificial Sequence: Synthetic polypeptide
EIVLTQSPGTLSLSPGDRVTLFCRASQNIANNHLAWYQQKPGQAPRVLIYGASTTATDIPDRFSGRVSGTDFTLTISRLDPEDFAVYYCHQYGSSPWTFGQGTKLEIK

SEQ ID NO: 11313 - protein, 23 aa, Artificial Sequence
  Description of Artificial Sequence: Synthetic peptide
EIVLTQSPGTLSLSPGDRVTLFC

SEQ ID NO: 11314 - protein, 12 aa, Artificial Sequence
  Description of Artificial Sequence: Synthetic peptide
RASQNIANNHLA

SEQ ID NO: 11315 - protein, 15 aa, Artificial Sequence
  Description of Artificial Sequence: Synthetic peptide
WYQQKPGQAPRVLIY

SEQ ID NO: 11316 - protein, 7 aa, Artificial Sequence
  Description of Artificial Sequence: Synthetic peptide
GASTTAT

SEQ ID NO: 11317 - protein, 32 aa, Artificial Sequence
  Description of Artificial Sequence: Synthetic polypeptide
DIPDRFSGRVSGTDFTLTISRLDPEDFAVYYC

SEQ ID NO: 11318 - protein, 9 aa, Artificial Sequence
  Description of Artificial Sequence: Synthetic peptide
HQYGSSPWT

SEQ ID NO: 11319 - protein, 10 aa, Artificial Sequence
  Description of Artificial Sequence: Synthetic peptide
FGQGTKLEIK

SEQ ID NO: 11320 - DNA, 324 bp, Artificial Sequence
  Description of Artificial Sequence: Synthetic polynucleotide
gaaattgtgttgacacagtctccaggcaccctgtctttgtctccaggggatagagtcaccctcttctgtagggccagtcagaatattgccaacaaccacttagcctggtaccagcagaaacctggccaggctcccagggtcctcatctatggtgcatccaccacggccactgacatcccagacaggttcagtggtcgggtgtctgggaccgacttcactctcaccatcagcagactggaccctgaagattttgcagtgtattactgtcaccagtatggttcctcaccgtggacgttcggccaagggaccaagctggagatcaaa

SEQ ID NO: 11321-11401 - skipped (81 entries)

SEQ ID NO: 11402 - protein, 123 aa, Artificial Sequence
  Description of Artificial Sequence: Synthetic polypeptide
EVQLLESGGGVVQPGRSLRLSCVTSGFDFRPYAMQWVRQAPGKGLEWVAVISHDGVHTGYADSLKGRFTISRDNSKNTLYLQVDSLRPDDSALYYCARDNALQNAQIGYLDYWGQGTLVTVSS

SEQ ID NO: 11403 - protein, 26 aa, Artificial Sequence
  Description of Artificial Sequence: Synthetic peptide
EVQLLESGGGVVQPGRSLRLSCVTSG

SEQ ID NO: 11404 - protein, 9 aa, Artificial Sequence
  Description of Artificial Sequence: Synthetic peptide
FDFRPYAMQ

SEQ ID NO: 11405 - protein, 14 aa, Artificial Sequence
  Description of Artificial Sequence: Synthetic peptide
WVRQAPGKGLEWVA

SEQ ID NO: 11406 - protein, 17 aa, Artificial Sequence
  Description of Artificial Sequence: Synthetic peptide
VISHDGVHTGYADSLKG

SEQ ID NO: 11407 - protein, 30 aa, Artificial Sequence; identical to SEQ ID NO: 10807
  Description of Artificial Sequence: Synthetic polypeptide

SEQ ID NO: 11408 - protein, 16 aa, Artificial Sequence
  Description of Artificial Sequence: Synthetic peptide
ARDNALQNAQIGYLDY

SEQ ID NO: 11409 - protein, 11 aa, Artificial Sequence
  Description of Artificial Sequence: Synthetic peptide
WGQGTLVTVSS

SEQ ID NO: 11410 - DNA, 369 bp, Artificial Sequence
  Description of Artificial Sequence: Synthetic polynucleotide
gaggtgcagctgttggagtctgggggaggcgtggtccagcctgggaggtcgctgagactctcctgtgtcacgtctggattcgacttcaggccatatgctatgcagtgggtccgccaggctccaggcaaggggctggagtgggtggcagttatttcacatgatggagtccacacaggctacgcagactccctgaagggccgattcaccatctccagagacaattccaagaacacgctctatttgcaagtggacagcctgagacctgacgactcggctctctattactgtgcgagagataacgcactgcagaacgctcaaattggataccttgactactggggccagggaaccctggtcaccgtctcttca

SEQ ID NO: 11411 - skipped

SEQ ID NO: 11412 - protein, 106 aa, Artificial Sequence
  Description of Artificial Sequence: Synthetic polypeptide
ETTLTQSPATLSVSPGETATLSCRASQSVGRFMGWYQQKPGQAPRLLIFDASNRVTGVPDRFRGSGSGTDFILTINSLEPEDSASYYCQRRGDGYNFGQGTKVEIK

SEQ ID NO: 11413 - protein, 23 aa, Artificial Sequence
  Description of Artificial Sequence: Synthetic peptide
ETTLTQSPATLSVSPGETATLSC

SEQ ID NO: 11414 - protein, 11 aa, Artificial Sequence
  Description of Artificial Sequence: Synthetic peptide
RASQSVGRFMG

SEQ ID NO: 11415 - protein, 15 aa, Artificial Sequence
  Description of Artificial Sequence: Synthetic peptide
WYQQKPGQAPRLLIF

SEQ ID NO: 11416 - protein, 7 aa, Artificial Sequence
  Description of Artificial Sequence: Synthetic peptide
DASNRVT

SEQ ID NO: 11417 - protein, 32 aa, Artificial Sequence; identical to SEQ ID NO: 10817
  Description of Artificial Sequence: Synthetic polypeptide

SEQ ID NO: 11418 - protein, 8 aa, Artificial Sequence
  Description of Artificial Sequence: Synthetic peptide
QRRGDGYN

SEQ ID NO: 11419 - protein, 10 aa, Artificial Sequence
  Description of Artificial Sequence: Synthetic peptide
FGQGTKVEIK

SEQ ID NO: 11420 - DNA, 318 bp, Artificial Sequence
  Description of Artificial Sequence: Synthetic polynucleotide
gaaacgacactcacgcagtctccagccacactgtctgtgtctccaggggaaacagccaccctctcctgcagggccagtcagagtgttggaaggttcatgggttggtatcaacagaaacctggccaggctcccaggctcctcatttttgatgcatcgaatagggtcactggcgtcccagacaggttccgtggcagtgggtctgggacagacttcattctcaccatcaacagcctagagcctgaagattctgcaagttattactgtcagcgccgtggcgacgggtacaattttggccaggggaccaaggtggaaatcaaa

SEQ ID NO: 11421-11501 - skipped (81 entries)

SEQ ID NO: 11502 - protein, 126 aa, Artificial Sequence
  Description of Artificial Sequence: Synthetic polypeptide
QVQLVQSGAEVKKPGSSVEVSCKVSGGTFRDYAISWVRQAPGQRLEWMGGIMPGLGSPAYAQIFGDRVTISADTSTSTAYLQVTNLRPEDTAVYYCARDPSILNTGNHHWYDLDMWGQGTTVTVSS

SEQ ID NO: 11503 - protein, 26 aa, Artificial Sequence
  Description of Artificial Sequence: Synthetic peptide
QVQLVQSGAEVKKPGSSVEVSCKVSG

SEQ ID NO: 11504 - protein, 9 aa, Artificial Sequence
  Description of Artificial Sequence: Synthetic peptide
GTFRDYAIS

SEQ ID NO: 11505 - protein, 14 aa, Artificial Sequence
  Description of Artificial Sequence: Synthetic peptide
WVRQAPGQRLEWMG

SEQ ID NO: 11506 - protein, 17 aa, Artificial Sequence
  Description of Artificial Sequence: Synthetic peptide
GIMPGLGSPAYAQIFGD

SEQ ID NO: 11507 - protein, 30 aa, Artificial Sequence
  Description of Artificial Sequence: Synthetic polypeptide
RVTISADTSTSTAYLQVTNLRPEDTAVYYC

SEQ ID NO: 11508 - protein, 19 aa, Artificial Sequence
  Description of Artificial Sequence: Synthetic peptide
ARDPSILNTGNHHWYDLDM

SEQ ID NO: 11509 - protein, 11 aa, Artificial Sequence
  Description of Artificial Sequence: Synthetic peptide
WGQGTTVTVSS

SEQ ID NO: 11510 - DNA, 378 bp, Artificial Sequence
  Description of Artificial Sequence: Synthetic polynucleotide
caggtccagctggtacagtctggggctgaggtgaagaagcctgggtcctcggtggaggtctcctgcaaggtttctggaggcacgttcagggactatgccatcagttgggtgcgacaggcccctggacaacgacttgagtggatgggagggatcatgcctggccttggttcgccagcctacgcacagatttttggggacagagtcaccatttccgcggacacatccacgagcacggcctacctgcaagtgaccaacctgaggcctgaggacacggccgtgtattactgtgcgagagacccgtctattcttaacactgggaatcaccactggtatgatttagatatgtggggccaagggaccacggtcaccgtctcctca

SEQ ID NO: 11511 - skipped

SEQ ID NO: 11512 - protein, 112 aa, Artificial Sequence
  Description of Artificial Sequence: Synthetic polypeptide
DIRMTQSPLSLPVDLGQSASISCRSSQRVVHTNGNTYLHWFHQRPGQAPRRLIYKVSNRESGVPDRFSGSGSGTDFTLRISRVEAEDVGVYYCMQATDWPRTFGQGTKLEIK

SEQ ID NO: 11513 - protein, 23 aa, Artificial Sequence
  Description of Artificial Sequence: Synthetic peptide
DIRMTQSPLSLPVDLGQSASISC

SEQ ID NO: 11514 - protein, 16 aa, Artificial Sequence
  Description of Artificial Sequence: Synthetic peptide
RSSQRVVHTNGNTYLH

SEQ ID NO: 11515 - protein, 15 aa, Artificial Sequence
  Description of Artificial Sequence: Synthetic peptide
WFHQRPGQAPRRLIY

SEQ ID NO: 11516 - protein, 7 aa, Artificial Sequence
  Description of Artificial Sequence: Synthetic peptide
KVSNRES

SEQ ID NO: 11517 - protein, 32 aa, Artificial Sequence; identical to SEQ ID NO: 3517
  Description of Artificial Sequence: Synthetic polypeptide

SEQ ID NO: 11518 - protein, 9 aa, Artificial Sequence
  Description of Artificial Sequence: Synthetic peptide
MQATDWPRT

SEQ ID NO: 11519 - protein, 10 aa, Artificial Sequence
  Description of Artificial Sequence: Synthetic peptide
FGQGTKLEIK

SEQ ID NO: 11520 - DNA, 336 bp, Artificial Sequence
  Description of Artificial Sequence: Synthetic polynucleotide
gacatccggatgacccagtctccactctccctgcccgtcgacctcggacagtcggcctccatctcctgcaggtctagtcaaagggtcgtgcacactaatgggaacacctacttgcattggtttcaccagaggccaggccaagctccaaggcgcctcatttataaggtttctaaccgggagtccggggtcccagacagattcagcggcagtgggtcaggcactgatttcaccctgagaatcagcagggtggaggctgaggatgttggcgtttattactgcatgcaagctacagactggcctcggacgttcggccaagggaccaagctggagatcaaa

SEQ ID NO: 11521-11601 - skipped (81 entries)

SEQ ID NO: 11602 - protein, 126 aa, Artificial Sequence
  Description of Artificial Sequence: Synthetic polypeptide
QVQLVQSGAEVKKPGSSVKVSCRVSGGRFSDYAFSWLRQAPVKGLEWMGGIIPRLDRKGYSHIFQDRLTFTADESTSTTYMELSGLTSDDTAVYYCARDPTFLNSGNHFWYDVDIWGQGTTVTVSS

SEQ ID NO: 11603 - protein, 26 aa, Artificial Sequence
  Description of Artificial Sequence: Synthetic peptide
QVQLVQSGAEVKKPGSSVKVSCRVSG

SEQ ID NO: 11604 - protein, 9 aa, Artificial Sequence
  Description of Artificial Sequence: Synthetic peptide
GRFSDYAFS

SEQ ID NO: 11605 - protein, 14 aa, Artificial Sequence
  Description of Artificial Sequence: Synthetic peptide
WLRQAPVKGLEWMG

SEQ ID NO: 11606 - protein, 17 aa, Artificial Sequence
  Description of Artificial Sequence: Synthetic peptide
GIIPRLDRKGYSHIFQD

SEQ ID NO: 11607 - protein, 30 aa, Artificial Sequence
  Description of Artificial Sequence: Synthetic polypeptide
RLTFTADESTSTTYMELSGLTSDDTAVYYC

SEQ ID NO: 11608 - protein, 19 aa, Artificial Sequence
  Description of Artificial Sequence: Synthetic peptide
ARDPTFLNSGNHFWYDVDI

SEQ ID NO: 11609 - protein, 11 aa, Artificial Sequence
  Description of Artificial Sequence: Synthetic peptide
WGQGTTVTVSS

SEQ ID NO: 11610 - DNA, 378 bp, Artificial Sequence
  Description of Artificial Sequence: Synthetic polynucleotide
caggtccagctggtgcagtctggggctgaagtgaagaagcctggctcctcggtgaaggtctcctgtagggtttccggaggcagattcagtgactacgctttcagctggctgcgacaggcccccgtaaaaggactcgagtggatgggggggatcatccctcgtctagatagaaaaggatactcacacattttccaggacagactcacctttactgcggacgagtccaccagcaccacctacatggaattgagtggcctgacgtctgacgacacggccgtttattactgtgcaagagatccgacttttcttaacagtggaaatcacttctggtacgatgttgatatctggggccaagggaccacggtcaccgtctcctca

SEQ ID NO: 11611 - skipped

SEQ ID NO: 11612 - protein, 112 aa, Artificial Sequence
  Description of Artificial Sequence: Synthetic polypeptide
DIVMTQSPLSLSVTLGQAASISCTCSQTAVHSDGNTYLNWFHQRPGQSPRRLIYKVSNRDSGVPDRFSGSGSGTDFTLKINRVEAEDVGIYYCMQTTDWPRTFGQGTKVEIK

SEQ ID NO: 11613 - protein, 23 aa, Artificial Sequence
  Description of Artificial Sequence: Synthetic peptide
DIVMTQSPLSLSVTLGQAASISC

SEQ ID NO: 11614 - protein, 16 aa, Artificial Sequence
  Description of Artificial Sequence: Synthetic peptide
TCSQTAVHSDGNTYLN

SEQ ID NO: 11615 - protein, 15 aa, Artificial Sequence
  Description of Artificial Sequence: Synthetic peptide
WFHQRPGQSPRRLIY

SEQ ID NO: 11616 - protein, 7 aa, Artificial Sequence
  Description of Artificial Sequence: Synthetic peptide
KVSNRDS

SEQ ID NO: 11617 - protein, 32 aa, Artificial Sequence
  Description of Artificial Sequence: Synthetic polypeptide
GVPDRFSGSGSGTDFTLKINRVEAEDVGIYYC

SEQ ID NO: 11618 - protein, 9 aa, Artificial Sequence
  Description of Artificial Sequence: Synthetic peptide
MQTTDWPRT

SEQ ID NO: 11619 - protein, 10 aa, Artificial Sequence
  Description of Artificial Sequence: Synthetic peptide
FGQGTKVEIK

SEQ ID NO: 11620 - DNA, 336 bp, Artificial Sequence
  Description of Artificial Sequence: Synthetic polynucleotide
gatattgtgatgactcagtctccactctccctgtccgtcacccttggacaggcggcctccatctcctgcacctgtagtcaaacggccgtgcactctgatggaaacacctacctgaattggtttcaccagaggccaggccaatctccaaggcgcctcatttataaggtttctaatcgggactctggggtcccagacagattcagcggcagtgggtcaggcactgatttcacactgaaaatcaacagggtggaggctgaggatgttgggatttattactgcatgcaaactacagactggcctcggacgttcggccaagggaccaaggtggaaatcaaa

SEQ ID NO: 11621-11701 - skipped (81 entries)

SEQ ID NO: 11702 - protein, 126 aa, Artificial Sequence
  Description of Artificial Sequence: Synthetic polypeptide
QVQLVESGAEVKKPGSSVRVSCKASGGTFRKSAISWVRQAPGQGFEWMGGIIPTLDRRGFAQKFQDRLTMTADEFTSTAYMDLSDLRSDDTAVYYCARDASFPNTGNHFWYDFDLWGQGTTVTVSS

SEQ ID NO: 11703 - protein, 26 aa, Artificial Sequence
  Description of Artificial Sequence: Synthetic peptide
QVQLVESGAEVKKPGSSVRVSCKASG

SEQ ID NO: 11704 - protein, 9 aa, Artificial Sequence
  Description of Artificial Sequence: Synthetic peptide
GTFRKSAIS

SEQ ID NO: 11705 - protein, 14 aa, Artificial Sequence
  Description of Artificial Sequence: Synthetic peptide
WVRQAPGQGFEWMG

SEQ ID NO: 11706 - protein, 17 aa, Artificial Sequence
  Description of Artificial Sequence: Synthetic peptide
GIIPTLDRRGFAQKFQD

SEQ ID NO: 11707 - protein, 30 aa, Artificial Sequence
  Description of Artificial Sequence: Synthetic polypeptide
RLTMTADEFTSTAYMDLSDLRSDDTAVYYC

SEQ ID NO: 11708 - protein, 19 aa, Artificial Sequence
  Description of Artificial Sequence: Synthetic peptide
ARDASFPNTGNHFWYDFDL

SEQ ID NO: 11709 - protein, 11 aa, Artificial Sequence
  Description of Artificial Sequence: Synthetic peptide
WGQGTTVTVSS

SEQ ID NO: 11710 - DNA, 378 bp, Artificial Sequence
  Description of Artificial Sequence: Synthetic polynucleotide
caggtgcagctggtggaatctggggctgaagtgaagaagcctgggtcctcggtgagggtctcctgcaaggcttctggaggcaccttcaggaagtctgctatcagctgggtgcgacaggcccctggacaagggtttgagtggatgggagggatcatccctacccttgacagaagaggattcgcacagaagtttcaggacagactcacgatgaccgcggacgaattcacgagcactgcctacatggacctgagcgacctgaggtctgacgacacggccgtctattactgtgcgagagatgcgtcttttcctaatactgggaatcacttctggtatgattttgatttgtggggccaagggaccacggtcaccgtctcctca

SEQ ID NO: 11711 - skipped

SEQ ID NO: 11712 - protein, 112 aa, Artificial Sequence
  Description of Artificial Sequence: Synthetic polypeptide
ETTLTQSPVTLPVTLGQPASISCTSSRWLVHTNGNTYLNWFHQRPGQSPRRLIYQVSNRDSGVPDRFSGSGSGTDFTLQISRVEAEDVGVYYCMQGTEWPRTFGQGTKLEIK

SEQ ID NO: 11713 - protein, 23 aa, Artificial Sequence
  Description of Artificial Sequence: Synthetic peptide
ETTLTQSPVTLPVTLGQPASISC

SEQ ID NO: 11714 - protein, 16 aa, Artificial Sequence
  Description of Artificial Sequence: Synthetic peptide
TSSRWLVHTNGNTYLN

SEQ ID NO: 11715 - protein, 15 aa, Artificial Sequence
  Description of Artificial Sequence: Synthetic peptide
WFHQRPGQSPRRLIY

SEQ ID NO: 11716 - protein, 7 aa, Artificial Sequence
  Description of Artificial Sequence: Synthetic peptide
QVSNRDS

SEQ ID NO: 11717 - protein, 32 aa, Artificial Sequence
  Description of Artificial Sequence: Synthetic polypeptide
GVPDRFSGSGSGTDFTLQISRVEAEDVGVYYC

SEQ ID NO: 11718 - protein, 9 aa, Artificial Sequence
  Description of Artificial Sequence: Synthetic peptide
MQGTEWPRT

SEQ ID NO: 11719 - protein, 10 aa, Artificial Sequence
  Description of Artificial Sequence: Synthetic peptide
FGQGTKLEIK

SEQ ID NO: 11720 - DNA, 336 bp, Artificial Sequence
  Description of Artificial Sequence: Synthetic polynucleotide
gaaacgacactcacgcagtctccagtcaccctgcccgtcacccttggacagccggcctccatctcctgcacgtctagtcgatggctcgtacacactaatggaaacacttacttgaattggtttcatcagaggccaggccaatctccaaggcgcctcatttatcaggtttctaaccgggactctggggtcccagacagattcagcggcagtgggtcaggcactgatttcacactgcaaatcagcagggtggaggccgaggatgttggggtttattactgcatgcaaggtacagagtggcctcggacgttcggccaagggaccaagctggagatcaaa

SEQ ID NO: 11721-11801 - skipped (81 entries)

SEQ ID NO: 11802 - protein, 116 aa, Artificial Sequence
  Description of Artificial Sequence: Synthetic polypeptide
EVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARVGSGRVYWGQGTLVTVSS

SEQ ID NO: 11803 - protein, 26 aa, Artificial Sequence
  Description of Artificial Sequence: Synthetic peptide
EVQLVESGGGVVQPGRSLRLSCAASG

SEQ ID NO: 11804 - protein, 9 aa, Artificial Sequence
  Description of Artificial Sequence: Synthetic peptide
FTFSSYGMH

SEQ ID NO: 11805 - protein, 14 aa, Artificial Sequence
  Description of Artificial Sequence: Synthetic peptide
WVRQAPGKGLEWVA

SEQ ID NO: 11806 - protein, 17 aa, Artificial Sequence
  Description of Artificial Sequence: Synthetic peptide
VIWYDGSNKYYADSVKG

SEQ ID NO: 11807 - protein, 30 aa, Artificial Sequence
  Description of Artificial Sequence: Synthetic polypeptide
RFTISRDNSKNTLYLQMNSLRAEDTAVYYC

SEQ ID NO: 11808 - protein, 9 aa, Artificial Sequence
  Description of Artificial Sequence: Synthetic peptide
ARVGSGRVY

SEQ ID NO: 11809 - protein, 11 aa, Artificial Sequence
  Description of Artificial Sequence: Synthetic peptide
WGQGTLVTVSS

SEQ ID NO: 11810 - DNA, 348 bp, Artificial Sequence
  Description of Artificial Sequence: Synthetic polynucleotide
gaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagtggggagtgggagggtctactggggccagggaaccctggtcaccgtctcctca

SEQ ID NO: 11811 - skipped

SEQ ID NO: 11812 - protein, 113 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKVEIK

SEQ ID NO: 11813 - protein, 23 aa, Artificial Sequence
  Description of Artificial Sequence: Synthetic peptide
DIVMTQSPDSLAVSLGERATINC

SEQ ID NO: 11814 - protein, 17 aa, Artificial Sequence
  Description of Artificial Sequence: Synthetic peptide
KSSQSVLYSSNNKNYLA

SEQ ID NO: 11815 - protein, 15 aa, Artificial Sequence
  Description of Artificial Sequence: Synthetic peptide
WYQQKPGQPPKLLIY

SEQ ID NO: 11816 - protein, 7 aa, Artificial Sequence
  Description of Artificial Sequence: Synthetic peptide
WASTRES

SEQ ID NO: 11817 - protein, 32 aa, Artificial Sequence; identical to SEQ ID NO: 1617
  Description of Artificial Sequence: Synthetic polypeptide

SEQ ID NO: 11818 - protein, 9 aa, Artificial Sequence
  Description of Artificial Sequence: Synthetic peptide
QQYYSTPYT

SEQ ID NO: 11819 - protein, 10 aa, Artificial Sequence
  Description of Artificial Sequence: Synthetic peptide
FGQGTKVEIK

SEQ ID NO: 11820 - DNA, 339 bp, Artificial Sequence
  Description of Artificial Sequence: Synthetic polynucleotide
gatattgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaaggtggaaatcaaa

SEQ ID NO: 11821-11901 - skipped (81 entries)

SEQ ID NO: 11902 - protein, 130 aa, Artificial Sequence
  Description of Artificial Sequence: Synthetic polypeptide
QVQLVESGPGLVRPSGTLSVTCAVSGDSISSDYWCTWVRQSPGKGLEWIGKISHSGSLNYNPSLKSRVTMSVDKSKNHFSLKLASVTAADTAVYYCARVRIGASHHNFWSGYYTDAFDIWGQGTTVTVSS

SEQ ID NO: 11903 - protein, 26 aa, Artificial Sequence
  Description of Artificial Sequence: Synthetic peptide
QVQLVESGPGLVRPSGTLSVTCAVSG

SEQ ID NO: 11904 - protein, 10 aa, Artificial Sequence
  Description of Artificial Sequence: Synthetic peptide
DSISSDYWCT

SEQ ID NO: 11905 - protein, 14 aa, Artificial Sequence
  Description of Artificial Sequence: Synthetic peptide
WVRQSPGKGLEWIG

SEQ ID NO: 11906 - protein, 16 aa, Artificial Sequence
  Description of Artificial Sequence: Synthetic peptide
KISHSGSLNYNPSLKS

SEQ ID NO: 11907 - protein, 30 aa, Artificial Sequence
  Description of Artificial Sequence: Synthetic polypeptide
RVTMSVDKSKNHFSLKLASVTAADTAVYYC

SEQ ID NO: 11908 - protein, 23 aa, Artificial Sequence
  Description of Artificial Sequence: Synthetic peptide
ARVRIGASHHNFWSGYYTDAFDI

SEQ ID NO: 11909 - protein, 11 aa, Artificial Sequence
  Description of Artificial Sequence: Synthetic peptide
WGQGTTVTVSS

SEQ ID NO: 11910 - DNA, 390 bp, Artificial Sequence
  Description of Artificial Sequence: Synthetic polynucleotide
caggtgcagctggtggagtctggcccaggactggtgaggccttcggggaccctgtccgtgacctgcgctgtctctggtgactccatcagcagtgattattggtgtacgtgggtccgccagtccccagggaaggggctggagtggattgggaaaatctctcatagcgggagcctcaactacaacccgtccctcaagagtcgagttaccatgtcagtagacaagtcaaagaatcacttctccttgaagttggcctctgtgaccgccgcggacacggccgtgtattactgtgcgagagtgaggatcggcgcctctcatcacaacttttggagtggttattataccgatgcttttgatatctggggccaagggaccacggtcaccgtctcctca

SEQ ID NO: 11911 - skipped

SEQ ID NO: 11912 - protein, 109 aa, Artificial Sequence
  Description of Artificial Sequence: Synthetic polypeptide
DIVVTQSPGTLSLSPGERAALSCRASQSVGNNYLAWYQQKPGQAPRLLIYGATSRATGIPDRFSGSGSGTDFTLTISRLEPEDFAVYYCQQYGTSPVYTFGQGTKVEIK

SEQ ID NO: 11913 - protein, 23 aa, Artificial Sequence
  Description of Artificial Sequence: Synthetic peptide
DIVVTQSPGTLSLSPGERAALSC

SEQ ID NO: 11914 - protein, 12 aa, Artificial Sequence
  Description of Artificial Sequence: Synthetic peptide
RASQSVGNNYLA

SEQ ID NO: 11915 - protein, 15 aa, Artificial Sequence
  Description of Artificial Sequence: Synthetic peptide
WYQQKPGQAPRLLIY

SEQ ID NO: 11916 - protein, 7 aa, Artificial Sequence
  Description of Artificial Sequence: Synthetic peptide
GATSRAT

SEQ ID NO: 11917 - protein, 32 aa, Artificial Sequence; identical to SEQ ID NO: 2917
  Description of Artificial Sequence: Synthetic polypeptide

SEQ ID NO: 11918 - protein, 10 aa, Artificial Sequence
  Description of Artificial Sequence: Synthetic peptide
QQYGTSPVYT

SEQ ID NO: 11919 - protein, 10 aa, Artificial Sequence
  Description of Artificial Sequence: Synthetic peptide
FGQGTKVEIK

SEQ ID NO: 11920 - DNA, 327 bp, Artificial Sequence
  Description of Artificial Sequence: Synthetic polynucleotide
gacatcgtggtgacccagtctccaggcaccctgtctttgtccccaggggaaagagccgccctctcctgcagggccagtcagagtgttggaaataactacttagcctggtaccagcaaaaacctggccaggctcccaggctcctcatctatggtgcaaccagcagggccactggcatcccagacaggttcagtggaagtgggtctgggacagacttcactctcaccatcagcagactggagcctgaagattttgcagtgtattactgtcagcaatatggtacctcaccggtgtacacctttggccaggggaccaaggtggaaatcaaa

SEQ ID NO: 11921-12001 - skipped (81 entries)

SEQ ID NO: 12002 - protein, 128 aa, Artificial Sequence
  Description of Artificial Sequence: Synthetic polypeptide
QVQLVQSGAEVKKPGESLKISCKASGYSFTNYWVGWVRQMPAKGLEWMGIIWPDDSDTRYRPSFQGQVTISVDKSISTAYLHWNSLKASDNGMYFCARAPLASCSGGRCPTYNRFDLWGQGTLVTVSS

SEQ ID NO: 12003 - protein, 26 aa, Artificial Sequence
  Description of Artificial Sequence: Synthetic peptide
QVQLVQSGAEVKKPGESLKISCKASG

SEQ ID NO: 12004 - protein, 9 aa, Artificial Sequence
  Description of Artificial Sequence: Synthetic peptide
YSFTNYWVG

SEQ ID NO: 12005 - protein, 14 aa, Artificial Sequence
  Description of Artificial Sequence: Synthetic peptide
WVRQMPAKGLEWMG

SEQ ID NO: 12006 - protein, 17 aa, Artificial Sequence
  Description of Artificial Sequence: Synthetic peptide
IIWPDDSDTRYRPSFQG

SEQ ID NO: 12007 - protein, 30 aa, Artificial Sequence
  Description of Artificial Sequence: Synthetic polypeptide
QVTISVDKSISTAYLHWNSLKASDNGMYFC

SEQ ID NO: 12008 - protein, 21 aa, Artificial Sequence
  Description of Artificial Sequence: Synthetic peptide
ARAPLASCSGGRCPTYNRFDL

SEQ ID NO: 12009 - protein, 11 aa, Artificial Sequence
  Description of Artificial Sequence: Synthetic peptide
WGQGTLVTVSS

SEQ ID NO: 12010 - DNA, 384 bp, Artificial Sequence
  Description of Artificial Sequence: Synthetic polynucleotide
caggtccagcttgtacagtctggagcagaggtgaaaaagcccggggagtctctgaagatctcctgtaaggcttctggatacagttttactaactactgggtcggctgggtgcgccagatgcccgcgaaaggcctggagtggatggggatcatctggcctgatgactctgataccagatacaggccgtccttccaaggccaggtcaccatctcagtcgacaagtccatcagcaccgcctacctacactggaacagcctgaaggcctcggacaacggcatgtatttttgtgcgagagccccgctagcatcctgtagtggtggtaggtgcccgacgtacaatcggttcgacctctggggccagggaaccctggtcaccgtctcctca

SEQ ID NO: 12011 - skipped

SEQ ID NO: 12012 - protein, 110 aa, Artificial Sequence
  Description of Artificial Sequence: Synthetic polypeptide
QPVLTQPPSVSAAPGQKVTISCSGSSSNIENNYVSWYQQLPGAAPKLLIYDNNKRPSGIPDRFSGSKSGTSATLGITGLQTGDEADYYCGTWDFSLSAGVFGGGTKLTVL

SEQ ID NO: 12013 - protein, 22 aa, Artificial Sequence
  Description of Artificial Sequence: Synthetic peptide
QPVLTQPPSVSAAPGQKVTISC

SEQ ID NO: 12014 - protein, 13 aa, Artificial Sequence
  Description of Artificial Sequence: Synthetic peptide
SGSSSNIENNYVS

SEQ ID NO: 12015 - protein, 15 aa, Artificial Sequence
  Description of Artificial Sequence: Synthetic peptide
WYQQLPGAAPKLLIY

SEQ ID NO: 12016 - protein, 7 aa, Artificial Sequence
  Description of Artificial Sequence: Synthetic peptide
DNNKRPS

SEQ ID NO: 12017 - protein, 32 aa, Artificial Sequence; identical to SEQ ID NO: 2117
  Description of Artificial Sequence: Synthetic polypeptide

SEQ ID NO: 12018 - protein, 11 aa, Artificial Sequence
  Description of Artificial Sequence: Synthetic peptide
GTWDFSLSAGV

SEQ ID NO: 12019 - protein, 10 aa, Artificial Sequence
  Description of Artificial Sequence: Synthetic peptide
FGGGTKLTVL

SEQ ID NO: 12020 - DNA, 330 bp, Artificial Sequence
  Description of Artificial Sequence: Synthetic polynucleotide
cagcctgtgctgactcagccgccctcagtgtctgcggccccaggacagaaggtcaccatctcctgctctggaagcagctccaacattgagaataattatgtatcctggtaccagcagctcccaggagctgcccccaaactcctcatttatgacaataataagcgaccctcagggattcctgaccgattctctggctccaagtctggcacgtctgccaccctgggcatcaccggactccagactggggacgaggccgattattactgcggaacatgggatttcagcctgagtgctggggtattcggcggagggaccaagctcaccgtccta

SEQ ID NO: 12021-12101 - skipped (81 entries)

SEQ ID NO: 12102 - protein, 125 aa, Artificial Sequence
  Description of Artificial Sequence: Synthetic polypeptide
QVQLVQSGAEVKKPGSSMKVSCKASGVNFRSYSFSWVRQAPGQGLEWMGGVIPYFPTANYADKFRDRVTITADESTGTVYLDMSSLRSEDTAVYFCASEYFDGRSYHSFCGLDVWGQGTTVTVSS

SEQ ID NO: 12103 - protein, 26 aa, Artificial Sequence
  Description of Artificial Sequence: Synthetic peptide
QVQLVQSGAEVKKPGSSMKVSCKASG

SEQ ID NO: 12104 - protein, 9 aa, Artificial Sequence
  Description of Artificial Sequence: Synthetic peptide
VNFRSYSFS

SEQ ID NO: 12105 - protein, 14 aa, Artificial Sequence
  Description of Artificial Sequence: Synthetic peptide
WVRQAPGQGLEWMG

SEQ ID NO: 12106 - protein, 17 aa, Artificial Sequence
  Description of Artificial Sequence: Synthetic peptide
GVIPYFPTANYADKFRD

SEQ ID NO: 12107 - protein, 30 aa, Artificial Sequence
  Description of Artificial Sequence: Synthetic polypeptide
RVTITADESTGTVYLDMSSLRSEDTAVYFC

SEQ ID NO: 12108 - protein, 18 aa, Artificial Sequence
  Description of Artificial Sequence: Synthetic peptide
ASEYFDGRSYHSFCGLDV

SEQ ID NO: 12109 - protein, 11 aa, Artificial Sequence
  Description of Artificial Sequence: Synthetic peptide
WGQGTTVTVSS

SEQ ID NO: 12110 - DNA, 375 bp, Artificial Sequence
  Description of Artificial Sequence: Synthetic polynucleotide
caggtccagcttgtacagtctggggctgaggtgaagaagcctgggtcttcgatgaaggtctcctgcaaggcttctggggtcaactttaggagttattctttcagctgggtgcgacaggcccctggacaagggcttgagtggatgggcggcgtcatcccttactttccgacagcgaactacgcagacaagttccgggacagggtcacgattaccgcggacgagtccacgggcacagtgtatttggacatgagcagcctgagatctgaagacacggccgtctacttttgtgcgagcgagtattttgatggtcgttcttaccactccttctgcggcttggacgtctggggccaagggaccacggtcaccgtctcttca

SEQ ID NO: 12111 - skipped

SEQ ID NO: 12112 - protein, 112 aa, Artificial Sequence
  Description of Artificial Sequence: Synthetic polypeptide
ETTLTQSPLSLPVTLGQPASISCRSSQGLVHTNGNLYLNWFHQRPGQSPRRLIYQVSNRDSGVPDRFSGSGSGTDFTLRISRVEAEDVGIYYCMQGTEWPRTFGQGTKVEIK

SEQ ID NO: 12113 - protein, 23 aa, Artificial Sequence
  Description of Artificial Sequence: Synthetic peptide
ETTLTQSPLSLPVTLGQPASISC

SEQ ID NO: 12114 - protein, 16 aa, Artificial Sequence
  Description of Artificial Sequence: Synthetic peptide
RSSQGLVHTNGNLYLN

SEQ ID NO: 12115 - protein, 15 aa, Artificial Sequence
  Description of Artificial Sequence: Synthetic peptide
WFHQRPGQSPRRLIY

SEQ ID NO: 12116 - protein, 7 aa, Artificial Sequence
  Description of Artificial Sequence: Synthetic peptide
QVSNRDS

SEQ ID NO: 12117 - protein, 32 aa, Artificial Sequence
  Description of Artificial Sequence: Synthetic polypeptide
GVPDRFSGSGSGTDFTLRISRVEAEDVGIYYC

SEQ ID NO: 12118 - protein, 9 aa, Artificial Sequence
  Description of Artificial Sequence: Synthetic peptide
MQGTEWPRT

SEQ ID NO: 12119 - protein, 10 aa, Artificial Sequence
  Description of Artificial Sequence: Synthetic peptide
FGQGTKVEIK

SEQ ID NO: 12120 - DNA, 336 bp, Artificial Sequence
  Description of Artificial Sequence: Synthetic polynucleotide
gaaacgacactcacgcagtctccactctccctgcccgtcacccttggacagccggcctccatctcctgcaggtctagtcaaggcctcgtacacactaatggaaacctgtacttgaattggtttcaccagaggccaggccaatctccaaggcgcctaatttatcaagtttctaaccgggactctggggtcccagacagattcagcggcagtgggtcaggcactgatttcacactgagaatcagtagggtggaggctgaggatgttggaatttattactgcatgcaaggcacagaatggcctcggacgttcggccaagggaccaaggtggaaatcaaa

SEQ ID NO: 12121-12201 - skipped (81 entries)

SEQ ID NO: 12202 - protein, 123 aa, Artificial Sequence
  Description of Artificial Sequence: Synthetic polypeptide
QVQLVESGGGLVQPGGSLRLSCAASGFTFSNYAMTWVRQAPGKGLKWVSGINPSGDATFYTDSVKGQFTISRDNSKNILYLQMNRLRADDTAIYYCAKGLSFYGSGSDAFDVWGQGTTVTVSS

SEQ ID NO: 12203 - protein, 26 aa, Artificial Sequence
  Description of Artificial Sequence: Synthetic peptide
QVQLVESGGGLVQPGGSLRLSCAASG

SEQ ID NO: 12204 - protein, 9 aa, Artificial Sequence
  Description of Artificial Sequence: Synthetic peptide
FTFSNYAMT

SEQ ID NO: 12205 - protein, 14 aa, Artificial Sequence
  Description of Artificial Sequence: Synthetic peptide
WVRQAPGKGLKWVS

SEQ ID NO: 12206 - protein, 17 aa, Artificial Sequence
  Description of Artificial Sequence: Synthetic peptide
GINPSGDATFYTDSVKG

SEQ ID NO: 12207 - protein, 30 aa, Artificial Sequence
  Description of Artificial Sequence: Synthetic polypeptide
QFTISRDNSKNILYLQMNRLRADDTAIYYC

SEQ ID NO: 12208 - protein, 16 aa, Artificial Sequence
  Description of Artificial Sequence: Synthetic peptide
AKGLSFYGSGSDAFDV

SEQ ID NO: 12209 - protein, 11 aa, Artificial Sequence
  Description of Artificial Sequence: Synthetic peptide
WGQGTTVTVSS

SEQ ID NO: 12210 - DNA, 369 bp, Artificial Sequence
  Description of Artificial Sequence: Synthetic polynucleotide
caggtgcagctggtggaatctgggggaggcttggtgcagcctggggggtccctgagactctcctgtgcagcctctggattcacttttagcaactatgccatgacctgggtccgccaggctccagggaaggggctgaagtgggtctcaggtattaatcctagtggtgatgccacattctacacagactccgtgaagggccagttcaccatctccagggacaattccaagaacatactatatctacaaatgaacagactgagagccgacgacacggccatatactactgtgcgaaagggctcagtttctatggttcgggaagtgatgcttttgatgtctggggccaagggaccacggtcaccgtctcctca

SEQ ID NO: 12211 - skipped

SEQ ID NO: 12212 - protein, 106 aa, Artificial Sequence
  Description of Artificial Sequence: Synthetic polypeptide
DIQLTQSPSTLSASVGDSVTITCRASQSISSWLAWYQQKPGKAPKLLIYKASSLETGVPSRFSGSGSGTEFTLTISSLQPDDFATYYCQQYKSPLSFGGGTKVEIK

SEQ ID NO: 12213 - protein, 23 aa, Artificial Sequence
  Description of Artificial Sequence: Synthetic peptide
DIQLTQSPSTLSASVGDSVTITC

SEQ ID NO: 12214 - protein, 11 aa, Artificial Sequence
  Description of Artificial Sequence: Synthetic peptide
RASQSISSWLA

SEQ ID NO: 12215 - protein, 15 aa, Artificial Sequence
  Description of Artificial Sequence: Synthetic peptide
WYQQKPGKAPKLLIY

SEQ ID NO: 12216 - protein, 7 aa, Artificial Sequence
  Description of Artificial Sequence: Synthetic peptide
KASSLET

SEQ ID NO: 12217 - protein, 32 aa, Artificial Sequence; identical to SEQ ID NO: 6717
  Description of Artificial Sequence: Synthetic polypeptide

SEQ ID NO: 12218 - protein, 8 aa, Artificial Sequence
  Description of Artificial Sequence: Synthetic peptide
QQYKSPLS

SEQ ID NO: 12219 - protein, 10 aa, Artificial Sequence
  Description of Artificial Sequence: Synthetic peptide
FGGGTKVEIK

SEQ ID NO: 12220 - DNA, 318 bp, Artificial Sequence
  Description of Artificial Sequence: Synthetic polynucleotide
gacatccagttgacccagtctccttccaccctgtctgcatctgtaggagacagcgtcaccatcacttgccgggccagtcagagtattagtagttggttggcctggtatcagcagaaaccagggaaagcccctaaactcctgatctataaggcgtctagtttagaaactggggtcccatcaaggttcagcggcagtggatctgggacagaattcactctcaccatcagcagcctgcagcctgatgattttgcaacttattactgccaacagtataagagccctctcagtttcggcggagggaccaaggtggagatcaaa

SEQ ID NO: 12221-12301 - skipped (81 entries)

SEQ ID NO: 12302 - protein, 124 aa, Artificial Sequence
  Description of Artificial Sequence: Synthetic polypeptide
QVQLVQSGAEVKKPGASVKVSCKASGYTFTDYYVHWVRQVPGQGLEWMGWISPDSGDTIRAQNFQGRVTMTRDTSMNTAYMEVNRLRTDDTAIYYCARDLISVIRGLGGGMDVWGQGTTVTVSS

SEQ ID NO: 12303 - protein, 26 aa, Artificial Sequence
  Description of Artificial Sequence: Synthetic peptide
QVQLVQSGAEVKKPGASVKVSCKASG

SEQ ID NO: 12304 - protein, 9 aa, Artificial Sequence
  Description of Artificial Sequence: Synthetic peptide
YTFTDYYVH

SEQ ID NO: 12305 - protein, 14 aa, Artificial Sequence
  Description of Artificial Sequence: Synthetic peptide
WVRQVPGQGLEWMG

SEQ ID NO: 12306 - protein, 17 aa, Artificial Sequence
  Description of Artificial Sequence: Synthetic peptide
WISPDSGDTIRAQNFQG

SEQ ID NO: 12307 - protein, 30 aa, Artificial Sequence
  Description of Artificial Sequence: Synthetic polypeptide
RVTMTRDTSMNTAYMEVNRLRTDDTAIYYC

SEQ ID NO: 12308 - protein, 17 aa, Artificial Sequence
  Description of Artificial Sequence: Synthetic peptide
ARDLISVIRGLGGGMDV

SEQ ID NO: 12309 - protein, 11 aa, Artificial Sequence
  Description of Artificial Sequence: Synthetic peptide
WGQGTTVTVSS

SEQ ID NO: 12310 - DNA, 372 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccgactactatgtccactgggtgcgacaggtccctggacaagggcttgagtggatgggatggatcagccctgacagtggtgacacaatccgtgcacagaactttcagggcagggtcaccatgaccagggacacgtccatgaacacagcctacatggaagtgaacaggctgagaactgacgacacggccatatattattgtgcgagagatctcattagtgtaattcgaggattaggggggggtatggacgtctggggccaagggaccacggtcaccgtctcctca

SEQ ID NO: 12311 - skipped

SEQ ID NO: 12312 - protein, 108 aa, Artificial Sequence
  Description of Artificial Sequence: Synthetic polypeptide
DIQVTQSPATLSLSPGERATLSCRASQSVSSYLAWYQQKPGQAPRLLIYDASKRATGIPARFSGSGSGTDFTLTISSLEPEDFAVYYCQQRSDWHPITFGQGTRLEIK

SEQ ID NO: 12313 - protein, 23 aa, Artificial Sequence
  Description of Artificial Sequence: Synthetic peptide
DIQVTQSPATLSLSPGERATLSC

SEQ ID NO: 12314 - protein, 11 aa, Artificial Sequence
  Description of Artificial Sequence: Synthetic peptide
RASQSVSSYLA

SEQ ID NO: 12315 - protein, 15 aa, Artificial Sequence
  Description of Artificial Sequence: Synthetic peptide
WYQQKPGQAPRLLIY

SEQ ID NO: 12316 - protein, 7 aa, Artificial Sequence
  Description of Artificial Sequence: Synthetic peptide
DASKRAT

SEQ ID NO: 12317 - protein, 32 aa, Artificial Sequence; identical to SEQ ID NO: 4517
  Description of Artificial Sequence: Synthetic polypeptide

SEQ ID NO: 12318 - protein, 10 aa, Artificial Sequence
  Description of Artificial Sequence: Synthetic peptide
QQRSDWHPIT

SEQ ID NO: 12319 - protein, 10 aa, Artificial Sequence
  Description of Artificial Sequence: Synthetic peptide
FGQGTRLEIK

SEQ ID NO: 12320 - DNA, 324 bp, Artificial Sequence
  Description of Artificial Sequence: Synthetic polynucleotide
gacatccaggtgacccagtctccagccaccctgtctttgtctccaggggaaagagccaccctctcctgcagggccagtcagagtgttagcagctacttagcctggtaccaacagaaacctggccaggctcccaggctcctcatctatgatgcatccaagagggccactggcatcccagccaggttcagtggcagtgggtctgggacagactttactctcaccatcagcagcctagagcctgaagattttgcagtttattactgtcagcagcgtagcgactggcacccgatcaccttcggccaagggacacgactggagattaaa

SEQ ID NO: 12321-12401 - skipped (81 entries)

SEQ ID NO: 12402 - protein, 126 aa, Artificial Sequence
  Description of Artificial Sequence: Synthetic polypeptide
QVQLVQSGAEVKKPGASVKVSCKTSGYTFTGHYIHWVRQAPGQGLEWMGWINPASGDTNYAQKFQGRVTKTRDTSITTAYMELNRLRSDDTAVYYCARGGPLPWSDLDIVGTFDYWGQGTLVTVSS

SEQ ID NO: 12403 - protein, 26 aa, Artificial Sequence
  Description of Artificial Sequence: Synthetic peptide
QVQLVQSGAEVKKPGASVKVSCKTSG

SEQ ID NO: 12404 - protein, 9 aa, Artificial Sequence
  Description of Artificial Sequence: Synthetic peptide
YTFTGHYIH

SEQ ID NO: 12405 - protein, 14 aa, Artificial Sequence
  Description of Artificial Sequence: Synthetic peptide
WVRQAPGQGLEWMG

SEQ ID NO: 12406 - protein, 17 aa, Artificial Sequence
  Description of Artificial Sequence: Synthetic peptide
WINPASGDTNYAQKFQG

SEQ ID NO: 12407 - protein, 30 aa, Artificial Sequence
  Description of Artificial Sequence: Synthetic polypeptide
RVTKTRDTSITTAYMELNRLRSDDTAVYYC

SEQ ID NO: 12408 - protein, 19 aa, Artificial Sequence
  Description of Artificial Sequence: Synthetic peptide
ARGGPLPWSDLDIVGTFDY

SEQ ID NO: 12409 - protein, 11 aa, Artificial Sequence
  Description of Artificial Sequence: Synthetic peptide
WGQGTLVTVSS

SEQ ID NO: 12410 - DNA, 378 bp, Artificial Sequence
  Description of Artificial Sequence: Synthetic polynucleotide
caggtccagctggtgcagtctggggctgaggtgaagaagcctggggcctcagtgaaggtctcctgcaagacttctggatacactttcaccggccactacatacactgggtgcgacaggcccctggacaagggcttgagtggatgggttggatcaaccctgccagtggtgacacaaactatgcacagaaatttcagggcagggtcaccaagaccagggacacgtccatcaccacagcctacatggaactgaataggctgagatctgacgacacggccgtgtattactgtgcgagaggggggcctctcccgtggagcgacctggatatagtgggtacatttgactactggggccagggaaccctggtcaccgtctcttca

SEQ ID NO: 12411 - skipped

SEQ ID NO: 12412 - protein, 106 aa, Artificial Sequence
  Description of Artificial Sequence: Synthetic polypeptide
DIQVTQSPSSLSASVGDRVTITCRASQSISSSLNWYQQKPGKAPTLLIYTASNLQSGVPSRFSGSGSGTDFTLTITSLQPEDFATYYCQQSYSTPGFGPGTKVDIK

SEQ ID NO: 12413 - protein, 23 aa, Artificial Sequence
  Description of Artificial Sequence: Synthetic peptide
DIQVTQSPSSLSASVGDRVTITC

SEQ ID NO: 12414 - protein, 11 aa, Artificial Sequence
  Description of Artificial Sequence: Synthetic peptide
RASQSISSSLN

SEQ ID NO: 12415 - protein, 15 aa, Artificial Sequence
  Description of Artificial Sequence: Synthetic peptide
WYQQKPGKAPTLLIY

SEQ ID NO: 12416 - protein, 7 aa, Artificial Sequence
  Description of Artificial Sequence: Synthetic peptide
TASNLQS

SEQ ID NO: 12417 - protein, 32 aa, Artificial Sequence
  Description of Artificial Sequence: Synthetic polypeptide
GVPSRFSGSGSGTDFTLTITSLQPEDFATYYC

SEQ ID NO: 12418 - protein, 8 aa, Artificial Sequence
  Description of Artificial Sequence: Synthetic peptide
QQSYSTPG

SEQ ID NO: 12419 - protein, 10 aa, Artificial Sequence
  Description of Artificial Sequence: Synthetic peptide
FGPGTKVDIK

SEQ ID NO: 12420 - DNA, 318 bp, Artificial Sequence
  Description of Artificial Sequence: Synthetic polynucleotide
gacatccaggtgacccagtctccatcctccctgtctgcatctgtaggagacagagttaccatcacttgccgggcaagtcagagcattagcagctctttaaattggtatcaacagaaaccagggaaagcccctactctcctgatctatactgcatccaatttgcaaagtggggtcccatcaaggttcagtggcagtggatctgggacagatttcactctcaccatcaccagtctgcaacctgaagattttgcaacttactactgtcaacagagttacagtaccccaggtttcggccctgggaccaaagtggatatcaaa

SEQ ID NO: 12421-12501 - skipped (81 entries)

SEQ ID NO: 12502 - protein, 125 aa, Artificial Sequence
  Description of Artificial Sequence: Synthetic polypeptide
EVQLVESGGGVVQPGKSLRLSCVPSGFSFGTYGMHWVRQAPGKGPEWLAVMWYDGITQYYADSVKGRFTISRDNSKETLYLQMNSLTADDTGIYYCVKDQSSGDRLLYLGYFDLWGPGALVTVSS

SEQ ID NO: 12503 - protein, 26 aa, Artificial Sequence
  Description of Artificial Sequence: Synthetic peptide
EVQLVESGGGVVQPGKSLRLSCVPSG

SEQ ID NO: 12504 - protein, 9 aa, Artificial Sequence
  Description of Artificial Sequence: Synthetic peptide
FSFGTYGMH

SEQ ID NO: 12505 - protein, 14 aa, Artificial Sequence
  Description of Artificial Sequence: Synthetic peptide
WVRQAPGKGPEWLA

SEQ ID NO: 12506 - protein, 17 aa, Artificial Sequence
  Description of Artificial Sequence: Synthetic peptide
VMWYDGITQYYADSVKG

SEQ ID NO: 12507 - protein, 30 aa, Artificial Sequence
  Description of Artificial Sequence: Synthetic polypeptide
RFTISRDNSKETLYLQMNSLTADDTGIYYC

SEQ ID NO: 12508 - protein, 18 aa, Artificial Sequence
  Description of Artificial Sequence: Synthetic peptide
VKDQSSGDRLLYLGYFDL

SEQ ID NO: 12509 - protein, 11 aa, Artificial Sequence
  Description of Artificial Sequence: Synthetic peptide
WGPGALVTVSS

SEQ ID NO: 12510 - DNA, 375 bp, Artificial Sequence
  Description of Artificial Sequence: Synthetic polynucleotide
gaggtgcagctggtggagtctgggggcggtgtagtccagcctgggaagtccctcaggctctcctgtgtaccctctggattcagtttcgggacctatggcatgcattgggtccgccaggctccgggcaaggggccggagtggctggcagtcatgtggtatgatggaataactcagtactatgcagactccgtgaagggccgatttaccatctccagagacaattccaaggagactctctatctccagatgaatagtctgacagccgacgacacgggaatttattactgtgttaaagatcagtcgtctggggaccgtttattatacctggggtacttcgatctctggggccctggcgccctggtcaccgtctcctca

SEQ ID NO: 12511 - skipped

SEQ ID NO: 12512 - protein, 109 aa, Artificial Sequence
  Description of Artificial Sequence: Synthetic polypeptide
EIVMTQSPATLSLSPGERATLSCRASQSVSIYLAWYQQKPGQAPRLLIYDASNRATGVPARFSGSGSGTDFTLTINNLEPEDFAIYYCQQRAKWPPRVTFGPGTKVDIK

SEQ ID NO: 12513 - protein, 23 aa, Artificial Sequence
  Description of Artificial Sequence: Synthetic peptide
EIVMTQSPATLSLSPGERATLSC

SEQ ID NO: 12514 - protein, 11 aa, Artificial Sequence
  Description of Artificial Sequence: Synthetic peptide
RASQSVSIYLA

SEQ ID NO: 12515 - protein, 15 aa, Artificial Sequence
  Description of Artificial Sequence: Synthetic peptide
WYQQKPGQAPRLLIY

SEQ ID NO: 12516 - protein, 7 aa, Artificial Sequence
  Description of Artificial Sequence: Synthetic peptide
DASNRAT

SEQ ID NO: 12517 - protein, 32 aa, Artificial Sequence
  Description of Artificial Sequence: Synthetic polypeptide
GVPARFSGSGSGTDFTLTINNLEPEDFAIYYC

SEQ ID NO: 12518 - protein, 11 aa, Artificial Sequence
  Description of Artificial Sequence: Synthetic peptide
QQRAKWPPRVT

SEQ ID NO: 12519 - protein, 10 aa, Artificial Sequence
  Description of Artificial Sequence: Synthetic peptide
FGPGTKVDIK

SEQ ID NO: 12520 - DNA, 327 bp, Artificial Sequence
  Description of Artificial Sequence: Synthetic polynucleotide
gaaattgtaatgacgcagtctccagccaccctgtctttgtctccaggggaaagagccaccctctcctgcagggccagtcagagtgttagtatttacttagcttggtaccaacagaagcctggccaggctcccaggctcctcatctatgatgcttcgaatagggccactggcgtcccagccaggttcagcggcagtgggtctgggacagacttcactctcaccatcaacaacctagagcctgaagattttgcaatttattactgtcagcagcgtgccaagtggcctccgagggtcaccttcggccctgggaccaaagtggatatcaaa

SEQ ID NO: 12521-12601 - skipped (81 entries)

SEQ ID NO: 12602 - protein, 125 aa, Artificial Sequence
  Description of Artificial Sequence: Synthetic polypeptide
QVQLVQSGGGVVQPGKSLRLSCVASGFSFGTYGMHWVRQAPGKGPEWLAVMWYDGITQYYADSVKGRFTISRDNSKETLYLQMNSLTADDTGVYYCVKDQSSGDRLLYLGYFDLWGPGTLVTVSS

SEQ ID NO: 12603 - protein, 26 aa, Artificial Sequence
  Description of Artificial Sequence: Synthetic peptide
QVQLVQSGGGVVQPGKSLRLSCVASG

SEQ ID NO: 12604 - protein, 9 aa, Artificial Sequence
  Description of Artificial Sequence: Synthetic peptide
FSFGTYGMH

SEQ ID NO: 12605 - protein, 14 aa, Artificial Sequence
  Description of Artificial Sequence: Synthetic peptide
WVRQAPGKGPEWLA

SEQ ID NO: 12606 - protein, 17 aa, Artificial Sequence
  Description of Artificial Sequence: Synthetic peptide
VMWYDGITQYYADSVKG

SEQ ID NO: 12607 - protein, 30 aa, Artificial Sequence
  Description of Artificial Sequence: Synthetic polypeptide
RFTISRDNSKETLYLQMNSLTADDTGVYYC

SEQ ID NO: 12608 - protein, 18 aa, Artificial Sequence
  Description of Artificial Sequence: Synthetic peptide
VKDQSSGDRLLYLGYFDL

SEQ ID NO: 12609 - protein, 11 aa, Artificial Sequence
  Description of Artificial Sequence: Synthetic peptide
WGPGTLVTVSS

SEQ ID NO: 12610 - DNA, 375 bp, Artificial Sequence
  Description of Artificial Sequence: Synthetic polynucleotide
caggtccagcttgtgcagtctgggggcggtgtggtccagcctgggaagtccctcaggctctcctgtgtagcgtctggattcagtttcgggacctatggcatgcattgggtccgccaggctccgggcaaggggccggagtggctggcagtcatgtggtatgatggaataactcagtactatgcagactccgtgaagggccgatttaccatctccagagacaattccaaggagactctctatctccagatgaatagcctgacagccgacgacacgggagtttattactgtgttaaagatcagtcgtctggggaccgcttattatacctggggtacttcgatctctggggccctggcaccctggtcaccgtctcctca

SEQ ID NO: 12611 - skipped

SEQ ID NO: 12612 - protein, 109 aa, Artificial Sequence
  Description of Artificial Sequence: Synthetic polypeptide
DIVLTQSPATLSLSPGERATLSCRASQSVSIYLAWYQQKPGQAPRLLIYDASNRATGIPARFSGSGSGTDFTLTINNLEPEDFAIYYCQQRAKWPPRVIFGPGTKVEIK

SEQ ID NO: 12613 - protein, 23 aa, Artificial Sequence
  Description of Artificial Sequence: Synthetic peptide
DIVLTQSPATLSLSPGERATLSC

SEQ ID NO: 12614 - protein, 11 aa, Artificial Sequence
  Description of Artificial Sequence: Synthetic peptide
RASQSVSIYLA

SEQ ID NO: 12615 - protein, 15 aa, Artificial Sequence
  Description of Artificial Sequence: Synthetic peptide
WYQQKPGQAPRLLIY

SEQ ID NO: 12616 - protein, 7 aa, Artificial Sequence
  Description of Artificial Sequence: Synthetic peptide
DASNRAT

SEQ ID NO: 12617 - protein, 32 aa, Artificial Sequence
  Description of Artificial Sequence: Synthetic polypeptide
GIPARFSGSGSGTDFTLTINNLEPEDFAIYYC

SEQ ID NO: 12618 - protein, 11 aa, Artificial Sequence
  Description of Artificial Sequence: Synthetic peptide
QQRAKWPPRVI

SEQ ID NO: 12619 - protein, 10 aa, Artificial Sequence
  Description of Artificial Sequence: Synthetic peptide
FGPGTKVEIK

SEQ ID NO: 12620 - DNA, 327 bp, Artificial Sequence
  Description of Artificial Sequence: Synthetic polynucleotide
gatattgtgctgacccagtctccagccaccctgtctttgtctccaggggaaagagccaccctctcctgcagggccagtcagagtgttagtatttacttagcttggtaccagcagaagcctggccaggctcccaggctcctcatctatgatgcttcgaacagggccactggcatcccagccaggttcagcggcagtgggtctgggacagacttcactctcaccatcaacaacctagagcctgaagattttgcaatttattactgtcagcagcgtgccaagtggcctccgagggtcattttcggccctgggaccaaggtggaaatcaaa

SEQ ID NO: 12621-12701 - skipped (81 entries)

SEQ ID NO: 12702 - protein, 127 aa, Artificial Sequence; identical to SEQ ID NO: 7602
  Description of Artificial Sequence: Synthetic polypeptide

SEQ ID NO: 12703 - protein, 26 aa, Artificial Sequence
  Description of Artificial Sequence: Synthetic peptide
QVQLQESGPGLVKPSGTLSLTCAVSG

SEQ ID NO: 12704 - protein, 10 aa, Artificial Sequence
  Description of Artificial Sequence: Synthetic peptide
ASVSSDHWWS

SEQ ID NO: 12705 - protein, 14 aa, Artificial Sequence
  Description of Artificial Sequence: Synthetic peptide
WVRQSPGKGLEWIG

SEQ ID NO: 12706 - protein, 16 aa, Artificial Sequence
  Description of Artificial Sequence: Synthetic peptide
EVYHSGSTNYNPSLKS

SEQ ID NO: 12707 - protein, 30 aa, Artificial Sequence; identical to SEQ ID NO: 7407
  Description of Artificial Sequence: Synthetic polypeptide

SEQ ID NO: 12708 - protein, 20 aa, Artificial Sequence
  Description of Artificial Sequence: Synthetic peptide
ATMWGGLCTASNCYGNPMDV

SEQ ID NO: 12709 - protein, 11 aa, Artificial Sequence
  Description of Artificial Sequence: Synthetic peptide
WGQGTTVTVSS

SEQ ID NO: 12710 - DNA, 381 bp, Artificial Sequence; identical to SEQ ID NO: 10710
  Description of Artificial Sequence: Synthetic polynucleotide

SEQ ID NO: 12711 - skipped

SEQ ID NO: 12712 - protein, 108 aa, Artificial Sequence
  Description of Artificial Sequence: Synthetic polypeptide
SYELTQPPSVSVSPGQTARITCSGDALPRRYAYWYQQRSGQAPVLVIYEDNKRPSGIPERFSAFSSGTMATLTISGAQVEDEADYYCYSTDSTANYKVFGGGTKLTVL

SEQ ID NO: 12713 - protein, 22 aa, Artificial Sequence
  Description of Artificial Sequence: Synthetic peptide
SYELTQPPSVSVSPGQTARITC

SEQ ID NO: 12714 - protein, 11 aa, Artificial Sequence
  Description of Artificial Sequence: Synthetic peptide
SGDALPRRYAY

SEQ ID NO: 12715 - protein, 15 aa, Artificial Sequence
  Description of Artificial Sequence: Synthetic peptide
WYQQRSGQAPVLVIY

SEQ ID NO: 12716 - protein, 7 aa, Artificial Sequence
  Description of Artificial Sequence: Synthetic peptide
EDNKRPS

SEQ ID NO: 12717 - protein, 32 aa, Artificial Sequence
  Description of Artificial Sequence: Synthetic polypeptide
GIPERFSAFSSGTMATLTISGAQVEDEADYYC

SEQ ID NO: 12718 - protein, 11 aa, Artificial Sequence
  Description of Artificial Sequence: Synthetic peptide
YSTDSTANYKV

SEQ ID NO: 12719 - protein, 10 aa, Artificial Sequence
  Description of Artificial Sequence: Synthetic peptide
FGGGTKLTVL

SEQ ID NO: 12720 - DNA, 324 bp, Artificial Sequence
  Description of Artificial Sequence: Synthetic polynucleotide
tcctatgagctgacacagccaccctcggtgtcagtgtccccaggacaaacggccaggatcacctgctctggagatgcattgcctagaagatatgcctattggtaccagcagaggtcaggccaggcccctgtgttggtcatctatgaagacaataaacgaccctccgggatccctgagagattctctgccttcagctcagggacaatggccaccttgactatcagtggggcccaggtagaggatgaagctgactactactgttactcaacagacagcactgccaattataaggtgtttggcggagggaccaagctgaccgtccta

SEQ ID NO: 12721-12801 - skipped (81 entries)

SEQ ID NO: 12802 - protein, 128 aa, Artificial Sequence
  Description of Artificial Sequence: Synthetic polypeptide
QVQLQQWGAGVLKPSETLSLTCAVYGGSFRGFFWSWIRQPPGKGLEWIGQITHSGSTNYNSSLKSRLTISVDTSKNQFSLNLSSVTAADTAIYYCARGQGGYDLRRVGYGLTSWFDPWGQGILVTVSS

SEQ ID NO: 12803 - protein, 26 aa, Artificial Sequence
  Description of Artificial Sequence: Synthetic peptide
QVQLQQWGAGVLKPSETLSLTCAVYG

SEQ ID NO: 12804 - protein, 9 aa, Artificial Sequence
  Description of Artificial Sequence: Synthetic peptide
GSFRGFFWS

SEQ ID NO: 12805 - protein, 14 aa, Artificial Sequence
  Description of Artificial Sequence: Synthetic peptide
WIRQPPGKGLEWIG

SEQ ID NO: 12806 - protein, 16 aa, Artificial Sequence
  Description of Artificial Sequence: Synthetic peptide
QITHSGSTNYNSSLKS

SEQ ID NO: 12807 - protein, 30 aa, Artificial Sequence
  Description of Artificial Sequence: Synthetic polypeptide
RLTISVDTSKNQFSLNLSSVTAADTAIYYC

SEQ ID NO: 12808 - protein, 22 aa, Artificial Sequence
  Description of Artificial Sequence: Synthetic peptide
ARGQGGYDLRRVGYGLTSWFDP

SEQ ID NO: 12809 - protein, 11 aa, Artificial Sequence
  Description of Artificial Sequence: Synthetic peptide
WGQGILVTVSS

SEQ ID NO: 12810 - DNA, 384 bp, Artificial Sequence
  Description of Artificial Sequence: Synthetic polynucleotide
caggtgcagctacagcagtggggcgcaggagtgttgaagccttcggagaccctgtccctcacttgcgctgtctatggtgggtccttcagaggtttcttctggagctggatccgccagcccccagggaaggggctggagtggattgggcaaatcactcatagtggaagcaccaactacaattcgtccctcaagagtcgtctcaccatatcagtagacacgtcgaagaaccagttctccctgaacctgagctctgtgaccgccgcggacacggcgatatattactgtgcgagaggccaggggggctacgatcttcgtcgggtgggctacgggttgacgtcctggttcgacccctggggccagggaattctggtcaccgtctcctca

SEQ ID NO: 12811 - skipped

SEQ ID NO: 12812 - protein, 112 aa, Artificial Sequence
  Description of Artificial Sequence: Synthetic polypeptide
QSVLIQPASVSGSPGQSITISCTGSSSDVGSYNLVSWYQQHPGKAPKLMIYEGYKRPSGVSNRFSGSKSGNTASLTISGLQAEDEADYYCCSYAGSSAVVVVFGGGTKLTVL

SEQ ID NO: 12813 - protein, 22 aa, Artificial Sequence
  Description of Artificial Sequence: Synthetic peptide
QSVLIQPASVSGSPGQSITISC

SEQ ID NO: 12814 - protein, 14 aa, Artificial Sequence
  Description of Artificial Sequence: Synthetic peptide
TGSSSDVGSYNLVS

SEQ ID NO: 12815 - protein, 15 aa, Artificial Sequence
  Description of Artificial Sequence: Synthetic peptide
WYQQHPGKAPKLMIY

SEQ ID NO: 12816 - protein, 7 aa, Artificial Sequence
  Description of Artificial Sequence: Synthetic peptide
EGYKRPS

SEQ ID NO: 12817 - protein, 32 aa, Artificial Sequence; identical to SEQ ID NO: 9017
  Description of Artificial Sequence: Synthetic polypeptide

SEQ ID NO: 12818 - protein, 12 aa, Artificial Sequence
  Description of Artificial Sequence: Synthetic peptide
CSYAGSSAVVVV

SEQ ID NO: 12819 - protein, 10 aa, Artificial Sequence
  Description of Artificial Sequence: Synthetic peptide
FGGGTKLTVL

SEQ ID NO: 12820 - DNA, 336 bp, Artificial Sequence
  Description of Artificial Sequence: Synthetic polynucleotide
cagtctgttctgattcagcctgcctccgtgtctgggtctccaggacagtcgatcaccatctcctgcactggaagtagcagtgatgttggcagttataaccttgtctcctggtaccaacagcacccaggcaaagcccccaaacttatgatttatgagggctataagcggccctcaggggtttctaatcgcttctctggctccaagtctggcaacacggcctccctgacaatctctggactccaggctgaggacgaggccgattattactgctgctcatatgcaggtagtagcgctgtcgttgtggtattcggcggcgggaccaagctcaccgtccta

SEQ ID NO: 12821-12901 - skipped (81 entries)

SEQ ID NO: 12902 - protein, 127 aa, Artificial Sequence
  Description of Artificial Sequence: Synthetic polypeptide
QVQLVQSGAEVKKPGASVKVSCKASGYTFTSYYIHWVRQAPGQGLEWLGVIHPSGGSTTFAQKFQGRVTMTRDTSTSTVYMELGSLRSDDTAVYYCARVLAGSSHEWQLTHDAFDIWGQGTTVTVSS

SEQ ID NO: 12903 - protein, 26 aa, Artificial Sequence
  Description of Artificial Sequence: Synthetic peptide
QVQLVQSGAEVKKPGASVKVSCKASG

SEQ ID NO: 12904 - protein, 9 aa, Artificial Sequence
  Description of Artificial Sequence: Synthetic peptide
YTFTSYYIH

SEQ ID NO: 12905 - protein, 14 aa, Artificial Sequence
  Description of Artificial Sequence: Synthetic peptide
WVRQAPGQGLEWLG

SEQ ID NO: 12906 - protein, 17 aa, Artificial Sequence
  Description of Artificial Sequence: Synthetic peptide
VIHPSGGSTTFAQKFQG

SEQ ID NO: 12907 - protein, 30 aa, Artificial Sequence
  Description of Artificial Sequence: Synthetic polypeptide
RVTMTRDTSTSTVYMELGSLRSDDTAVYYC

SEQ ID NO: 12908 - protein, 20 aa, Artificial Sequence
  Description of Artificial Sequence: Synthetic peptide
ARVLAGSSHEWQLTHDAFDI

SEQ ID NO: 12909 - protein, 11 aa, Artificial Sequence
  Description of Artificial Sequence: Synthetic peptide
WGQGTTVTVSS

SEQ ID NO: 12910 - DNA, 381 bp, Artificial Sequence
  Description of Artificial Sequence: Synthetic polynucleotide
caggtccagctggtacagtctggggctgaggtgaagaagcctggggcctcagtgaaggtttcctgcaaggcatctggatacaccttcaccagctattatatacactgggtgcgacaggcccctggacaagggcttgagtggctgggagtaatccaccctagtggtggtagcacaaccttcgcacagaagttccagggcagagtcaccatgaccagggacacgtccacgagcacagtctacatggagctgggcagcctgagatctgacgacacggccgtgtattactgtgcgagagttttagcgggcagttcccacgagtggcagctaacacatgatgcttttgatatctggggccaagggaccacggtcaccgtctcctca

SEQ ID NO: 12911 - skipped

SEQ ID NO: 12912 - protein, 113 aa, Artificial Sequence
  Description of Artificial Sequence: Synthetic polypeptide
DIRVTQSPDSLAVSLGERATINCRTSQSVLYSSNNKNYLGWYQQKPGQPPKLLIYWASTRESGVPDRFSGSGSGTDFTLTISSLQAEDVAVYYCQQYYSTPYTFGQGTKVDIK

SEQ ID NO: 12913 - protein, 23 aa, Artificial Sequence
  Description of Artificial Sequence: Synthetic peptide
DIRVTQSPDSLAVSLGERATINC

SEQ ID NO: 12914 - protein, 17 aa, Artificial Sequence
  Description of Artificial Sequence: Synthetic peptide
RTSQSVLYSSNNKNYLG

SEQ ID NO: 12915 - protein, 15 aa, Artificial Sequence
  Description of Artificial Sequence: Synthetic peptide
WYQQKPGQPPKLLIY

SEQ ID NO: 12916 - protein, 7 aa, Artificial Sequence
  Description of Artificial Sequence: Synthetic peptide
WASTRES

SEQ ID NO: 12917 - protein, 32 aa, Artificial Sequence; identical to SEQ ID NO: 1617
  Description of Artificial Sequence: Synthetic polypeptide

SEQ ID NO: 12918 - protein, 9 aa, Artificial Sequence
  Description of Artificial Sequence: Synthetic peptide
QQYYSTPYT

SEQ ID NO: 12919 - protein, 10 aa, Artificial Sequence
  Description of Artificial Sequence: Synthetic peptide
FGQGTKVDIK

SEQ ID NO: 12920 - DNA, 339 bp, Artificial Sequence
  Description of Artificial Sequence: Synthetic polynucleotide
gacatccgggtgacccagtctccagactccctggctgtgtctctgggcgagagggccaccatcaactgcaggaccagccagagtgttttatacagctccaacaataagaactacttaggttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcagtattatagtactccgtacacttttggccaggggaccaaagtggatatcaaa

SEQ ID NO: 12921-13001 - skipped (81 entries)

SEQ ID NO: 13002 - protein, 124 aa, Artificial Sequence
  Description of Artificial Sequence: Synthetic polypeptide
EVQLVESGAEVKKPGASVILSCKASGYTVTNYYIHWVRQAPGQGLEWMGWIDPDSGVTNFAEKFQGRVTMTRDTSISTAYMELRWLESDDTAVYYCAKDLITVIRGLGGGMDVWGQGTTVTVSS

SEQ ID NO: 13003 - protein, 26 aa, Artificial Sequence
  Description of Artificial Sequence: Synthetic peptide
EVQLVESGAEVKKPGASVILSCKASG

SEQ ID NO: 13004 - protein, 9 aa, Artificial Sequence
  Description of Artificial Sequence: Synthetic peptide
YTVTNYYIH

SEQ ID NO: 13005 - protein, 14 aa, Artificial Sequence
  Description of Artificial Sequence: Synthetic peptide
WVRQAPGQGLEWMG

SEQ ID NO: 13006 - protein, 17 aa, Artificial Sequence
  Description of Artificial Sequence: Synthetic peptide
WIDPDSGVTNFAEKFQG

SEQ ID NO: 13007 - protein, 30 aa, Artificial Sequence
  Description of Artificial Sequence: Synthetic polypeptide
RVTMTRDTSISTAYMELRWLESDDTAVYYC

SEQ ID NO: 13008 - protein, 17 aa, Artificial Sequence
  Description of Artificial Sequence: Synthetic peptide
AKDLITVIRGLGGGMDV

SEQ ID NO: 13009 - protein, 11 aa, Artificial Sequence
  Description of Artificial Sequence: Synthetic peptide
WGQGTTVTVSS

SEQ ID NO: 13010 - DNA, 372 bp, Artificial Sequence
  Description of Artificial Sequence: Synthetic polynucleotide
gaggtgcagctggtggaatctggggctgaggtgaagaagcctggggcctcagtgatactctcctgcaaggcttctggctacaccgtcaccaattactacatacactgggtccgacaggcccctggacaagggcttgagtggatgggatggatcgaccctgacagtggtgtcacaaactttgcagagaagtttcagggcagagtcaccatgaccagggacacgtccatcagcacagcctacatggaactgaggtggctggaatctgacgacacggccgtgtattactgtgcgaaagatctcattactgtgattcggggattaggggggggtatggacgtctggggccaagggaccacggtcaccgtctcctca

SEQ ID NO: 13011 - skipped

SEQ ID NO: 13012 - protein, 108 aa, Artificial Sequence
  Description of Artificial Sequence: Synthetic polypeptide
EIVLTQSPATLSLSPGERATLSCRASQSVSTYLAWYQQKPGQAPRLLIYDASNRATGIPARFSGSGSGTDFTLTISSLEPEDFALYYCLQRSDWHPITFGQGTRLEIK

SEQ ID NO: 13013 - protein, 23 aa, Artificial Sequence
  Description of Artificial Sequence: Synthetic peptide
EIVLTQSPATLSLSPGERATLSC

SEQ ID NO: 13014 - protein, 11 aa, Artificial Sequence
  Description of Artificial Sequence: Synthetic peptide
RASQSVSTYLA

SEQ ID NO: 13015 - protein, 15 aa, Artificial Sequence
  Description of Artificial Sequence: Synthetic peptide
WYQQKPGQAPRLLIY

SEQ ID NO: 13016 - protein, 7 aa, Artificial Sequence
  Description of Artificial Sequence: Synthetic peptide
DASNRAT

SEQ ID NO: 13017 - protein, 32 aa, Artificial Sequence
  Description of Artificial Sequence: Synthetic polypeptide
GIPARFSGSGSGTDFTLTISSLEPEDFALYYC

SEQ ID NO: 13018 - protein, 10 aa, Artificial Sequence
  Description of Artificial Sequence: Synthetic peptide
LQRSDWHPIT

SEQ ID NO: 13019 - protein, 10 aa, Artificial Sequence
  Description of Artificial Sequence: Synthetic peptide
FGQGTRLEIK

SEQ ID NO: 13020 - DNA, 324 bp, Artificial Sequence
  Description of Artificial Sequence: Synthetic polynucleotide
gaaattgtattgacacagtctccagccaccctgtctttgtctccaggggaaagagccaccctctcctgcagggccagtcagagtgttagcacctacttagcctggtaccaacagaaacctggccaggctcccaggctcctcatctatgatgcatccaacagggccactggcatcccagccaggttcagtggcagtgggtctgggacagacttcactctcaccatcagcagcctagaacctgaagattttgcactttattactgtctgcagcgtagcgactggcacccgatcaccttcggccaagggacacgactggagattaaa

SEQ ID NO: 13021-13101 - skipped (81 entries)

SEQ ID NO: 13102 - protein, 122 aa, Artificial Sequence
  Description of Artificial Sequence: Synthetic polypeptide
EVQLLESGAEVKKPGSSVKVSCKASGGTFSSDAISWVRQAPGQGLEWMGGIIPIFGTTNYAQKFQGRVTITADESTNTAYMELSSLRSEDTAVYYCARDGPYDSGGYHLNHWGQGTLVTVSS

SEQ ID NO: 13103 - protein, 26 aa, Artificial Sequence
  Description of Artificial Sequence: Synthetic peptide
EVQLLESGAEVKKPGSSVKVSCKASG

SEQ ID NO: 13104 - protein, 9 aa, Artificial Sequence
  Description of Artificial Sequence: Synthetic peptide
GTFSSDAIS

SEQ ID NO: 13105 - protein, 14 aa, Artificial Sequence
  Description of Artificial Sequence: Synthetic peptide
WVRQAPGQGLEWMG

SEQ ID NO: 13106 - protein, 17 aa, Artificial Sequence
  Description of Artificial Sequence: Synthetic peptide
GIIPIFGTTNYAQKFQG

SEQ ID NO: 13107 - protein, 30 aa, Artificial Sequence
  Description of Artificial Sequence: Synthetic polypeptide
RVTITADESTNTAYMELSSLRSEDTAVYYC

SEQ ID NO: 13108 - protein, 15 aa, Artificial Sequence
  Description of Artificial Sequence: Synthetic peptide
ARDGPYDSGGYHLNH

SEQ ID NO: 13109 - protein, 11 aa, Artificial Sequence
  Description of Artificial Sequence: Synthetic peptide
WGQGTLVTVSS

SEQ ID NO: 13110 - DNA, 366 bp, Artificial Sequence
  Description of Artificial Sequence: Synthetic polynucleotide
gaggtgcagctgttggagtctggggctgaggtgaagaagcctgggtcctcggtgaaggtctcctgcaaggcctctggaggcaccttcagcagcgatgctatcagctgggtgcgacaggcccctgggcaagggcttgagtggatgggcgggatcatccctatctttggtacaacaaactacgcacagaagttccagggcagagtcacgattaccgcggacgaatccacgaacacagcctacatggagctgagcagcctgagatctgaagacacggccgtgtattattgtgcgagagatggtccatatgatagtggaggttatcatctcaaccactggggccagggaaccctggtcaccgtctcttca

SEQ ID NO: 13111 - skipped

SEQ ID NO: 13112 - protein, 109 aa, Artificial Sequence
  Description of Artificial Sequence: Synthetic polypeptide
DIQLTQSPATLSLSPGERATLSCRANQSVSNFLAWYQQKPGQAPRHLIYDASNRATGIPARFSGSGSGTDFTLTISSLEPEDFAVYYCQQRSNWPPRLTFGGGTKVEIK

SEQ ID NO: 13113 - protein, 23 aa, Artificial Sequence
  Description of Artificial Sequence: Synthetic peptide
DIQLTQSPATLSLSPGERATLSC

SEQ ID NO: 13114 - protein, 11 aa, Artificial Sequence
  Description of Artificial Sequence: Synthetic peptide
RANQSVSNFLA

SEQ ID NO: 13115 - protein, 15 aa, Artificial Sequence
  Description of Artificial Sequence: Synthetic peptide
WYQQKPGQAPRHLIY

SEQ ID NO: 13116 - protein, 7 aa, Artificial Sequence
  Description of Artificial Sequence: Synthetic peptide
DASNRAT

SEQ ID NO: 13117 - protein, 32 aa, Artificial Sequence; identical to SEQ ID NO: 4517
  Description of Artificial Sequence: Synthetic polypeptide

SEQ ID NO: 13118 - protein, 11 aa, Artificial Sequence
  Description of Artificial Sequence: Synthetic peptide
QQRSNWPPRLT

SEQ ID NO: 13119 - protein, 10 aa, Artificial Sequence
  Description of Artificial Sequence: Synthetic peptide
FGGGTKVEIK

SEQ ID NO: 13120 - DNA, 327 bp, Artificial Sequence
  Description of Artificial Sequence: Synthetic polynucleotide
gacatccagttgacccagtctccagccaccctgtctttgtctccaggggaaagagccaccctctcctgcagggccaatcagagtgttagcaacttcttagcctggtaccaacagaaacctggccaggctcccaggcacctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccgaggctcactttcggcggagggaccaaggtggaaatcaaa

SEQ ID NO: 13121-13201 - skipped (81 entries)

SEQ ID NO: 13202 - protein, 120 aa, Artificial Sequence
  Description of Artificial Sequence: Synthetic polypeptide
EVQLLESGGGVVNPGGSMRLSCAGSGFTFSDHYMGWIRQAPGKGLEVISYISSSGSFIRDADSVKGRFTISRDNAKNSVYLQMNSLRAEDTAVYYCARMGPYGSGTFDYWGQGTLVTVSS

SEQ ID NO: 13203 - protein, 26 aa, Artificial Sequence
  Description of Artificial Sequence: Synthetic peptide
EVQLLESGGGVVNPGGSMRLSCAGSG

SEQ ID NO: 13204 - protein, 9 aa, Artificial Sequence
  Description of Artificial Sequence: Synthetic peptide
FTFSDHYMG

SEQ ID NO: 13205 - protein, 14 aa, Artificial Sequence
  Description of Artificial Sequence: Synthetic peptide
WIRQAPGKGLEVIS

SEQ ID NO: 13206 - protein, 17 aa, Artificial Sequence
  Description of Artificial Sequence: Synthetic peptide
YISSSGSFIRDADSVKG

SEQ ID NO: 13207 - protein, 30 aa, Artificial Sequence; identical to SEQ ID NO: 6407
  Description of Artificial Sequence: Synthetic polypeptide

SEQ ID NO: 13208 - protein, 13 aa, Artificial Sequence
  Description of Artificial Sequence: Synthetic peptide
ARMGPYGSGTFDY

SEQ ID NO: 13209 - protein, 11 aa, Artificial Sequence
  Description of Artificial Sequence: Synthetic peptide
WGQGTLVTVSS

SEQ ID NO: 13210 - DNA, 360 bp, Artificial Sequence
  Description of Artificial Sequence: Synthetic polynucleotide
gaggtgcagctgttggagtctgggggaggcgtggtcaaccctggagggtccatgagactctcctgtgcaggctctggattcactttcagtgaccactacatgggttggatccgccaggctccagggaaggggctggaggtgatttcatacattagtagttctgggtcctttataagggacgcagactctgtgaagggccgattcaccatctcccgagacaacgccaagaattcagtgtatctgcaaatgaacagcctgagggccgaagacacggctgtctattactgtgcgagaatgggcccctatggttcggggacctttgactactggggccagggaaccctggtcaccgtctcctca

SEQ ID NO: 13211 - skipped

SEQ ID NO: 13212 - protein, 107 aa, Artificial Sequence
  Description of Artificial Sequence: Synthetic polypeptide
DIVMTQTPGTLSVSPGERATLSCRASQIINRSQLGWYQHKPGQPPRLLIFDSSKRATGTPDRFSASGSETDFTLTISGVEPEDSGVYYCLQYSLATTFGPGTKVEIK

SEQ ID NO: 13213 - protein, 23 aa, Artificial Sequence
  Description of Artificial Sequence: Synthetic peptide
DIVMTQTPGTLSVSPGERATLSC

SEQ ID NO: 13214 - protein, 12 aa, Artificial Sequence
  Description of Artificial Sequence: Synthetic peptide
RASQIINRSQLG

SEQ ID NO: 13215 - protein, 15 aa, Artificial Sequence
  Description of Artificial Sequence: Synthetic peptide
WYQHKPGQPPRLLIF

SEQ ID NO: 13216 - protein, 7 aa, Artificial Sequence
  Description of Artificial Sequence: Synthetic peptide
DSSKRAT

SEQ ID NO: 13217 - protein, 32 aa, Artificial Sequence; identical to SEQ ID NO: 6417
  Description of Artificial Sequence: Synthetic polypeptide

SEQ ID NO: 13218 - protein, 8 aa, Artificial Sequence
  Description of Artificial Sequence: Synthetic peptide
LQYSLATT

SEQ ID NO: 13219 - protein, 10 aa, Artificial Sequence
  Description of Artificial Sequence: Synthetic peptide
FGPGTKVEIK

SEQ ID NO: 13220 - DNA, 321 bp, Artificial Sequence
  Description of Artificial Sequence: Synthetic polynucleotide
gatattgtgatgacccagactccaggcaccctgtctgtgtctccaggggaaagagccaccctctcctgcagggccagtcagattattaatagaagtcagttaggctggtatcagcacaaacctggccagcctcccaggctcctcatctttgattcatctaagagggccactggcaccccagacaggtttagtgccagtgggtctgagactgacttcactctcactattagtggagtggagcctgaggattctggggtttattactgtctccagtatagtcttgcaacgacgttcggcccagggaccaaggtggaaatcaaa

SEQ ID NO: 13221-13301 - skipped (81 entries)

SEQ ID NO: 13302 - protein, 124 aa, Artificial Sequence
  Description of Artificial Sequence: Synthetic polypeptide
EVQLVESGAEVRKPGSSVKVSCKATGGTFSSYGITWVRQAPGQGLEWMGRIIPTLGRTNYAQKFQGRVTITADKSTSTAHMELSSLRSEDTAVYYCARDLSTLQPDAIVNFDYWGQGTLVTVSS

SEQ ID NO: 13303 - protein, 26 aa, Artificial Sequence
  Description of Artificial Sequence: Synthetic peptide
EVQLVESGAEVRKPGSSVKVSCKATG

SEQ ID NO: 13304 - protein, 9 aa, Artificial Sequence
  Description of Artificial Sequence: Synthetic peptide
GTFSSYGIT

SEQ ID NO: 13305 - protein, 14 aa, Artificial Sequence
  Description of Artificial Sequence: Synthetic peptide
WVRQAPGQGLEWMG

SEQ ID NO: 13306 - protein, 17 aa, Artificial Sequence
  Description of Artificial Sequence: Synthetic peptide
RIIPTLGRTNYAQKFQG

SEQ ID NO: 13307 - protein, 30 aa, Artificial Sequence
  Description of Artificial Sequence: Synthetic polypeptide
RVTITADKSTSTAHMELSSLRSEDTAVYYC

SEQ ID NO: 13308 - protein, 17 aa, Artificial Sequence
  Description of Artificial Sequence: Synthetic peptide
ARDLSTLQPDAIVNFDY

SEQ ID NO: 13309 - protein, 11 aa, Artificial Sequence
  Description of Artificial Sequence: Synthetic peptide
WGQGTLVTVSS

SEQ ID NO: 13310 - DNA, 372 bp, Artificial Sequence
  Description of Artificial Sequence: Synthetic polynucleotide
gaggtgcagctggtggagtctggggctgaggtgaggaagcctgggtcctcggtgaaggtctcctgcaaggctactggaggcaccttcagtagttatggtatcacctgggtgcgacaggcccctggacaagggcttgagtggatgggaaggatcatccctacccttggtagaacaaactacgcacagaagtttcagggcagagtcacgattaccgcggacaaatccacgagcacagcccacatggaactgagcagcctgagatctgaggacacggccgtctattactgtgcgagagatcttagcactcttcaaccagatgctatagtcaactttgactactggggccagggaaccctggtcaccgtctcctca

SEQ ID NO: 13311 - skipped

SEQ ID NO: 13312 - protein, 112 aa, Artificial Sequence
  Description of Artificial Sequence: Synthetic polypeptide
QPVLTQSSSASASLGSSVKLTCTLSSGHSSYILAWHQQQPGKAPRFLMKFEVGGRYNKGSGVPDRFSGSSSGADRYLTISNLQSEDEADYYCETWDSNLKGVFGGGTKVTVL

SEQ ID NO: 13313 - protein, 22 aa, Artificial Sequence
  Description of Artificial Sequence: Synthetic peptide
QPVLTQSSSASASLGSSVKLTC

SEQ ID NO: 13314 - protein, 12 aa, Artificial Sequence
  Description of Artificial Sequence: Synthetic peptide
TLSSGHSSYILA

SEQ ID NO: 13315 - protein, 15 aa, Artificial Sequence
  Description of Artificial Sequence: Synthetic peptide
WHQQQPGKAPRFLMK

SEQ ID NO: 13316 - protein, 11 aa, Artificial Sequence
  Description of Artificial Sequence: Synthetic peptide
FEVGGRYNKGS

SEQ ID NO: 13317 - protein, 32 aa, Artificial Sequence
  Description of Artificial Sequence: Synthetic polypeptide
GVPDRFSGSSSGADRYLTISNLQSEDEADYYC

SEQ ID NO: 13318 - protein, 10 aa, Artificial Sequence
  Description of Artificial Sequence: Synthetic peptide
ETWDSNLKGV

SEQ ID NO: 13319 - protein, 10 aa, Artificial Sequence
  Description of Artificial Sequence: Synthetic peptide
FGGGTKVTVL

SEQ ID NO: 13320 - DNA, 336 bp, Artificial Sequence
  Description of Artificial Sequence: Synthetic polynucleotide
cagccagtgctgactcaatcatcctctgcctctgcttccctgggatcctcggtcaagctcacctgcactctgagcagtgggcacagtagctacatcctcgcatggcatcagcagcagccagggaaggcccctcggttcttgatgaagtttgaagttggtggaaggtacaacaaggggagcggagttcctgatcgcttctcaggatccagctctggggctgaccgctacctcaccatttccaacctccagtctgaggatgaggctgattattactgtgagacctgggacagtaacctcaagggggtgttcggcggagggaccaaggtgaccgtcctc

SEQ ID NO: 13321-13401 - skipped (81 entries)

SEQ ID NO: 13402 - protein, 123 aa, Artificial Sequence
  Description of Artificial Sequence: Synthetic polypeptide
QVQLVQSGAEVKKPGSSVKVSCKTSGGSFTSYVLSWVRQAPGQGLEWMGRIVPNLGVANYAQKFQDRVTITADKSTTTAYLELRSLRSEDTAVYYCARDLYYDNGGYNYLDYWGPGTLVTVSS

SEQ ID NO: 13403 - protein, 26 aa, Artificial Sequence
  Description of Artificial Sequence: Synthetic peptide
QVQLVQSGAEVKKPGSSVKVSCKTSG

SEQ ID NO: 13404 - protein, 9 aa, Artificial Sequence
  Description of Artificial Sequence: Synthetic peptide
GSFTSYVLS

SEQ ID NO: 13405 - protein, 14 aa, Artificial Sequence
  Description of Artificial Sequence: Synthetic peptide
WVRQAPGQGLEWMG

SEQ ID NO: 13406 - protein, 17 aa, Artificial Sequence
  Description of Artificial Sequence: Synthetic peptide
RIVPNLGVANYAQKFQD

SEQ ID NO: 13407 - protein, 30 aa, Artificial Sequence
  Description of Artificial Sequence: Synthetic polypeptide
RVTITADKSTTTAYLELRSLRSEDTAVYYC

SEQ ID NO: 13408 - protein, 16 aa, Artificial Sequence
  Description of Artificial Sequence: Synthetic peptide
ARDLYYDNGGYNYLDY

SEQ ID NO: 13409 - protein, 11 aa, Artificial Sequence
  Description of Artificial Sequence: Synthetic peptide
WGPGTLVTVSS

SEQ ID NO: 13410 - DNA, 369 bp, Artificial Sequence
  Description of Artificial Sequence: Synthetic polynucleotide
caggtgcagctggtgcagtctggggctgaggtgaagaagcctgggtcctctgtgaaggtctcctgcaagacttctggaggctccttcaccagttatgttctcagttgggtgcggcaggcccctggacaagggcttgagtggatgggaaggatcgtcccgaaccttggcgtagccaactacgcacagaagttccaggacagagtcaccattaccgcggacaaatctacgaccacagcctacctggagctgagaagcctgagatctgaggacacggccgtgtattactgtgcgagagatctttactatgacaatggtggttataactacctagactactggggccccggaactctggtcaccgtctcctca

SEQ ID NO: 13411 - skipped

SEQ ID NO: 13412 - protein, 112 aa, Artificial Sequence
  Description of Artificial Sequence: Synthetic polypeptide
QPVLTQSSSASASLGSSVKLTCTLRSGHSSYIIAWHQQQPGKAPRFLMKVGHSGSYNKGSGVPDRFSGSRSGADHYLTISNLQPDDEADYYCEAWDNNNLGVFSGGTKVTVL

SEQ ID NO: 13413 - protein, 22 aa, Artificial Sequence
  Description of Artificial Sequence: Synthetic peptide
QPVLTQSSSASASLGSSVKLTC

SEQ ID NO: 13414 - protein, 12 aa, Artificial Sequence
  Description of Artificial Sequence: Synthetic peptide
TLRSGHSSYIIA

SEQ ID NO: 13415 - protein, 15 aa, Artificial Sequence
  Description of Artificial Sequence: Synthetic peptide
WHQQQPGKAPRFLMK

SEQ ID NO: 13416 - protein, 11 aa, Artificial Sequence
  Description of Artificial Sequence: Synthetic peptide
VGHSGSYNKGS

SEQ ID NO: 13417 - protein, 32 aa, Artificial Sequence
  Description of Artificial Sequence: Synthetic polypeptide
GVPDRFSGSRSGADHYLTISNLQPDDEADYYC

SEQ ID NO: 13418 - protein, 10 aa, Artificial Sequence
  Description of Artificial Sequence: Synthetic peptide
EAWDNNNLGV

SEQ ID NO: 13419 - protein, 10 aa, Artificial Sequence
  Description of Artificial Sequence: Synthetic peptide
FSGGTKVTVL

SEQ ID NO: 13420 - DNA, 336 bp, Artificial Sequence
  Description of Artificial Sequence: Synthetic polynucleotide
cagcctgtgctgactcagtcatcctctgcctctgcttccctgggatcctcggtcaaactcacctgcactctgagaagtggacacagtagttacatcatcgcgtggcatcagcagcagccagggaaggcccctcgattcctgatgaaggttggacatagtggcagctacaacaaggggagcggagttcctgatcgcttctcaggctccaggtctggggctgaccactacctcaccatctccaacctccagcctgacgatgaagctgattattactgtgaggcctgggacaacaacaatttgggggtgttcagcggagggaccaaggtgaccgtccta

SEQ ID NO: 13421-13501 - skipped (81 entries)

SEQ ID NO: 13502 - protein, 127 aa, Artificial Sequence
  Description of Artificial Sequence: Synthetic polypeptide
QVQLVESGGGLVQPGGSLRLSCAASGFTFSNYNMVWVRQAPGKGLEWISYISSSSSTIYYADSVKGRFIISRDNAKNSLHLQMNSLRDEDTAVYYCVRDYCNSVSCYTYYYIGMDVWGQGTTVTVSS

SEQ ID NO: 13503 - protein, 26 aa, Artificial Sequence
  Description of Artificial Sequence: Synthetic peptide
QVQLVESGGGLVQPGGSLRLSCAASG

SEQ ID NO: 13504 - protein, 9 aa, Artificial Sequence
  Description of Artificial Sequence: Synthetic peptide
FTFSNYNMV

SEQ ID NO: 13505 - protein, 14 aa, Artificial Sequence
  Description of Artificial Sequence: Synthetic peptide
WVRQAPGKGLEWIS

SEQ ID NO: 13506 - protein, 17 aa, Artificial Sequence
  Description of Artificial Sequence: Synthetic peptide
YISSSSSTIYYADSVKG

SEQ ID NO: 13507 - protein, 30 aa, Artificial Sequence
  Description of Artificial Sequence: Synthetic polypeptide
RFIISRDNAKNSLHLQMNSLRDEDTAVYYC

SEQ ID NO: 13508 - protein, 20 aa, Artificial Sequence
  Description of Artificial Sequence: Synthetic peptide
VRDYCNSVSCYTYYYIGMDV

SEQ ID NO: 13509 - protein, 11 aa, Artificial Sequence
  Description of Artificial Sequence: Synthetic peptide
WGQGTTVTVSS

SEQ ID NO: 13510 - DNA, 381 bp, Artificial Sequence
  Description of Artificial Sequence: Synthetic polynucleotide
caggtgcagctggtggaatctgggggaggcttggttcaaccgggggggtccctgagactctcctgtgcagcctctggattcaccttcagtaactataacatggtctgggtccgccaggctccagggaaggggcttgagtggatttcatacattagtagtagtagtagtaccatttactacgcagactctgtgaagggccgattcatcatctccagagacaatgccaagaattcactgcatctacaaatgaacagcctgagagacgaggacacggctgtgtattactgtgtgagggattattgtaatagcgtcagctgctacacttactactacatcggtatggacgtctggggccaagggaccacggtcaccgtctcttca

SEQ ID NO: 13511 - skipped

SEQ ID NO: 13512 - protein, 107 aa, Artificial Sequence
  Description of Artificial Sequence: Synthetic polypeptide
DIQLTQSPSAMSASVGDRVTITCRASQGINDNLAWFQQKPGKVPKRLIYAASNLQNGVPSRFSGSGSGTEFTLTISSLQPEDFATYYCLQHNSYPLTFGGGTKLEIK

SEQ ID NO: 13513 - protein, 23 aa, Artificial Sequence
  Description of Artificial Sequence: Synthetic peptide
DIQLTQSPSAMSASVGDRVTITC

SEQ ID NO: 13514 - protein, 11 aa, Artificial Sequence
  Description of Artificial Sequence: Synthetic peptide
RASQGINDNLA

SEQ ID NO: 13515 - protein, 15 aa, Artificial Sequence
  Description of Artificial Sequence: Synthetic peptide
WFQQKPGKVPKRLIY

SEQ ID NO: 13516 - protein, 7 aa, Artificial Sequence
  Description of Artificial Sequence: Synthetic peptide
AASNLQN

SEQ ID NO: 13517 - protein, 32 aa, Artificial Sequence
  Description of Artificial Sequence: Synthetic polypeptide
GVPSRFSGSGSGTEFTLTISSLQPEDFATYYC

SEQ ID NO: 13518 - protein, 9 aa, Artificial Sequence
  Description of Artificial Sequence: Synthetic peptide
LQHNSYPLT

SEQ ID NO: 13519 - protein, 10 aa, Artificial Sequence
  Description of Artificial Sequence: Synthetic peptide
FGGGTKLEIK

SEQ ID NO: 13520 - DNA, 321 bp, Artificial Sequence
  Description of Artificial Sequence: Synthetic polynucleotide
gacatccagttgacccagtctccatctgccatgtctgcatctgttggagacagagtcaccatcacttgtcgggcgagtcagggcattaacgataatttagcctggtttcagcagaaaccagggaaagtccctaagcgcctgatctatgctgcatccaatttgcaaaatggggtcccatcaaggttcagcggcagtggatctgggacagaattcactctcacaatcagcagcctgcagcctgaagactttgcaacttattactgtctacagcataatagttaccctctcactttcggcggagggaccaagctggagatcaaa

SEQ ID NO: 13521-13601 - skipped (81 entries)

SEQ ID NO: 13602 - protein, 123 aa, Artificial Sequence
  Description of Artificial Sequence: Synthetic polypeptide
EVQLVQSGAEVKKPGASVKVSCKASGYSSTNYGFSWVRQAPGQGLEWMGWISVHSGNANFAQKFQGRITMTTDTSTTTAYMELRNLRSDDTATYYCATSASSYSRYYFGLDVWGQGTTVTVSS

SEQ ID NO: 13603 - protein, 26 aa, Artificial Sequence
  Description of Artificial Sequence: Synthetic peptide
EVQLVQSGAEVKKPGASVKVSCKASG

SEQ ID NO: 13604 - protein, 9 aa, Artificial Sequence
  Description of Artificial Sequence: Synthetic peptide
YSSTNYGFS

SEQ ID NO: 13605 - protein, 14 aa, Artificial Sequence
  Description of Artificial Sequence: Synthetic peptide
WVRQAPGQGLEWMG

SEQ ID NO: 13606 - protein, 17 aa, Artificial Sequence
  Description of Artificial Sequence: Synthetic peptide
WISVHSGNANFAQKFQG

SEQ ID NO: 13607 - protein, 30 aa, Artificial Sequence
  Description of Artificial Sequence: Synthetic polypeptide
RITMTTDTSTTTAYMELRNLRSDDTATYYC

SEQ ID NO: 13608 - protein, 16 aa, Artificial Sequence
  Description of Artificial Sequence: Synthetic peptide
ATSASSYSRYYFGLDV

SEQ ID NO: 13609 - protein, 11 aa, Artificial Sequence
  Description of Artificial Sequence: Synthetic peptide
WGQGTTVTVSS

SEQ ID NO: 13610 - DNA, 369 bp, Artificial Sequence
  Description of Artificial Sequence: Synthetic polynucleotide
gaggtgcagctggtgcagtctggagctgaagtgaagaagcctggggcctcagtgaaggtctcctgcaaggcctctggttacagctccaccaattacggtttcagctgggtgcgacaggcccctggacaaggccttgagtggatggggtggatcagcgttcacagtggaaatgcaaactttgcacagaaattccagggcagaatcactatgaccacagacacatccacgaccacagcctacatggagctgaggaacctcagatctgacgacacggccacatattactgtgcgacaagtgcgagctcctattctcggtattacttcggtctggatgtctggggccaagggaccacggtcaccgtctcctca

SEQ ID NO: 13611 - skipped

SEQ ID NO: 13612 - protein, 113 aa, Artificial Sequence
  Description of Artificial Sequence: Synthetic polypeptide
DIRMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPGVTFGGGTKVDIK

SEQ ID NO: 13613 - protein, 23 aa, Artificial Sequence
  Description of Artificial Sequence: Synthetic peptide
DIRMTQSPLSLPVTPGEPASISC

SEQ ID NO: 13614 - protein, 16 aa, Artificial Sequence
  Description of Artificial Sequence: Synthetic peptide
RSSQSLLHSNGYNYLD

SEQ ID NO: 13615 - protein, 15 aa, Artificial Sequence
  Description of Artificial Sequence: Synthetic peptide
WYLQKPGQSPQLLIY

SEQ ID NO: 13616 - protein, 7 aa, Artificial Sequence
  Description of Artificial Sequence: Synthetic peptide
LGSNRAS

SEQ ID NO: 13617 - protein, 32 aa, Artificial Sequence; identical to SEQ ID NO: 917
  Description of Artificial Sequence: Synthetic polypeptide

SEQ ID NO: 13618 - protein, 10 aa, Artificial Sequence
  Description of Artificial Sequence: Synthetic peptide
MQALQTPGVT

SEQ ID NO: 13619 - protein, 10 aa, Artificial Sequence
  Description of Artificial Sequence: Synthetic peptide
FGGGTKVDIK

SEQ ID NO: 13620 - DNA, 339 bp, Artificial Sequence
  Description of Artificial Sequence: Synthetic polynucleotide
gacatccggatgacccagtctccactctccctgcccgtcacccctggagagccggcctccatctcctgcaggtctagtcagagcctcctgcatagtaatggatacaactatttggattggtacctgcagaagccggggcagtctccacaactcctgatctatttgggttctaatcgggcctccggggtccctgacaggttcagtggcagtggttcaggcacagattttacactgaaaatcagcagagtggaggctgaggatgttggggtttattactgcatgcaagctctccaaactccaggggtcactttcggcggagggaccaaagtggatatcaaa

SEQ ID NO: 13621-13701 - skipped (81 entries)

SEQ ID NO: 13702 - protein, 126 aa, Artificial Sequence
  Description of Artificial Sequence: Synthetic polypeptide
EVQLLESGPGLVKPSQTLSLTCTVSNGFISSGEYYWSWIRQSPGKGLEWIGYISHSGSTYYNRSLKSRVTISLDTSRNQFSLNLSSVTAADTAVYYCARDLAKWSYGYYYSGMDVWGQGTTVTVSS

SEQ ID NO: 13703 - protein, 26 aa, Artificial Sequence
  Description of Artificial Sequence: Synthetic peptide
EVQLLESGPGLVKPSQTLSLTCTVSN

SEQ ID NO: 13704 - protein, 11 aa, Artificial Sequence
  Description of Artificial Sequence: Synthetic peptide
GFISSGEYYWS

SEQ ID NO: 13705 - protein, 14 aa, Artificial Sequence
  Description of Artificial Sequence: Synthetic peptide
WIRQSPGKGLEWIG

SEQ ID NO: 13706 - protein, 16 aa, Artificial Sequence
  Description of Artificial Sequence: Synthetic peptide
YISHSGSTYYNRSLKS

SEQ ID NO: 13707 - protein, 30 aa, Artificial Sequence
  Description of Artificial Sequence: Synthetic polypeptide
RVTISLDTSRNQFSLNLSSVTAADTAVYYC

SEQ ID NO: 13708 - protein, 18 aa, Artificial Sequence
  Description of Artificial Sequence: Synthetic peptide
ARDLAKWSYGYYYSGMDV

SEQ ID NO: 13709 - protein, 11 aa, Artificial Sequence
  Description of Artificial Sequence: Synthetic peptide
WGQGTTVTVSS

SEQ ID NO: 13710 - DNA, 378 bp, Artificial Sequence
  Description of Artificial Sequence: Synthetic polynucleotide
gaggtgcagctgttggagtcgggcccaggactggtgaagccttcacagaccctgtccctcacgtgcactgtctctaatggcttcatcagcagtggtgaatactactggagttggatccgccagtccccagggaagggcctggagtggattgggtacatcagtcacagtgggagcacctactacaaccggtccctcaagagtcgagttaccatatctctagacacgtccaggaaccagttctccctgaacctgagttctgtgaccgccgcagacacggccgtgtattattgtgccagagatttagcaaagtggagctatggttactactactccggaatggacgtctggggccaagggaccacggtcaccgtctcctca

SEQ ID NO: 13711 - skipped

SEQ ID NO: 13712 - protein, 110 aa, Artificial Sequence
  Description of Artificial Sequence: Synthetic polypeptide
QPVLTQPPSASGTPGQRVTISCSGSYSNIGTNPANWYQQLPGTAPKLLIYNNDQRPSGVPDRFSGSKSGTSASLAISGLQSEDETDYYCATWDDSLNGVVFGGGTKLTVL

SEQ ID NO: 13713 - protein, 22 aa, Artificial Sequence
  Description of Artificial Sequence: Synthetic peptide
QPVLTQPPSASGTPGQRVTISC

SEQ ID NO: 13714 - protein, 13 aa, Artificial Sequence
  Description of Artificial Sequence: Synthetic peptide
SGSYSNIGTNPAN

SEQ ID NO: 13715 - protein, 15 aa, Artificial Sequence
  Description of Artificial Sequence: Synthetic peptide
WYQQLPGTAPKLLIY

SEQ ID NO: 13716 - protein, 7 aa, Artificial Sequence
  Description of Artificial Sequence: Synthetic peptide
NNDQRPS

SEQ ID NO: 13717 - protein, 32 aa, Artificial Sequence
  Description of Artificial Sequence: Synthetic polypeptide
GVPDRFSGSKSGTSASLAISGLQSEDETDYYC

SEQ ID NO: 13718 - protein, 11 aa, Artificial Sequence
  Description of Artificial Sequence: Synthetic peptide
ATWDDSLNGVV

SEQ ID NO: 13719 - protein, 10 aa, Artificial Sequence
  Description of Artificial Sequence: Synthetic peptide
FGGGTKLTVL

SEQ ID NO: 13720 - DNA, 330 bp, Artificial Sequence
  Description of Artificial Sequence: Synthetic polynucleotide
cagcctgtgctgactcagccaccctcagcgtctgggacccccgggcagagggtcaccatctcttgttctggaagctactccaacatcggaactaatcctgcaaactggtaccagcagctcccaggaacggcccccaaactcctcatctataataatgatcagcggccctcaggggtccctgaccgattctctggctccaagtctggcacctcagcctccctggccatcagtgggctccagtctgaggatgagactgattattactgtgcaacatgggatgacagcctgaatggtgtggtattcggcggagggaccaagctgaccgtccta

SEQ ID NO: 13721-13801 - skipped (81 entries)

SEQ ID NO: 13802 - protein, 125 aa, Artificial Sequence
  Description of Artificial Sequence: Synthetic polypeptide
EVQLVESGGGLVQPGRSLRLSCAASGFTFDDYAMHWVRQVPGRGLEWVSGISWNSGTINYADSVMGRFTISRDNAKNSLYLQMNSLRAEDTALYYCAKDGRYCSGISCRTGMDVWGQGTTVTVSS

SEQ ID NO: 13803 - protein, 26 aa, Artificial Sequence
  Description of Artificial Sequence: Synthetic peptide
EVQLVESGGGLVQPGRSLRLSCAASG

SEQ ID NO: 13804 - protein, 9 aa, Artificial Sequence
  Description of Artificial Sequence: Synthetic peptide
FTFDDYAMH

SEQ ID NO: 13805 - protein, 14 aa, Artificial Sequence
  Description of Artificial Sequence: Synthetic peptide
WVRQVPGRGLEWVS

SEQ ID NO: 13806 - protein, 17 aa, Artificial Sequence
  Description of Artificial Sequence: Synthetic peptide
GISWNSGTINYADSVMG

SEQ ID NO: 13807 - protein, 30 aa, Artificial Sequence
  Description of Artificial Sequence: Synthetic polypeptide
RFTISRDNAKNSLYLQMNSLRAEDTALYYC

SEQ ID NO: 13808 - protein, 18 aa, Artificial Sequence
  Description of Artificial Sequence: Synthetic peptide
AKDGRYCSGISCRTGMDV

SEQ ID NO: 13809 - protein, 11 aa, Artificial Sequence
  Description of Artificial Sequence: Synthetic peptide
WGQGTTVTVSS

SEQ ID NO: 13810 - DNA, 375 bp, Artificial Sequence
  Description of Artificial Sequence: Synthetic polynucleotide
gaggtgcagctggtggagtctgggggaggcttagtgcagcctggcaggtccctgagactctcctgtgcagcctctggattcacctttgatgattatgccatgcactgggtccggcaagttccagggaggggcctggagtgggtctcaggtattagttggaatagcggtaccataaattatgcggactctgtgatgggccgattcaccatctccagagacaacgccaagaactccctgtatctgcaaatgaacagtctgagagctgaggacacggccttatattactgtgcaaaagatggtagatattgtagtggtatcagttgtcgcaccggtatggacgtctggggccaagggaccacggtcaccgtctcctca

SEQ ID NO: 13811 - skipped

SEQ ID NO: 13812 - protein, 107 aa, Artificial Sequence
  Description of Artificial Sequence: Synthetic polypeptide
EIVLTQSPSSLSASVGDRVTITCRASRSISSYLNWYQQKPGKAPNLLIYDASTLQSGVPSRFSGSGSGTDFSLTISSLQPEDFATYYCLHTYTTPRTFGQGTKVEIK

SEQ ID NO: 13813 - protein, 23 aa, Artificial Sequence
  Description of Artificial Sequence: Synthetic peptide
EIVLTQSPSSLSASVGDRVTITC

SEQ ID NO: 13814 - protein, 11 aa, Artificial Sequence
  Description of Artificial Sequence: Synthetic peptide
RASRSISSYLN

SEQ ID NO: 13815 - protein, 15 aa, Artificial Sequence
  Description of Artificial Sequence: Synthetic peptide
WYQQKPGKAPNLLIY

SEQ ID NO: 13816 - protein, 7 aa, Artificial Sequence
  Description of Artificial Sequence: Synthetic peptide
DASTLQS

SEQ ID NO: 13817 - protein, 32 aa, Artificial Sequence
  Description of Artificial Sequence: Synthetic polypeptide
GVPSRFSGSGSGTDFSLTISSLQPEDFATYYC

SEQ ID NO: 13818 - protein, 9 aa, Artificial Sequence
  Description of Artificial Sequence: Synthetic peptide
LHTYTTPRT

SEQ ID NO: 13819 - protein, 10 aa, Artificial Sequence
  Description of Artificial Sequence: Synthetic peptide
FGQGTKVEIK

SEQ ID NO: 13820 - DNA, 321 bp, Artificial Sequence
  Description of Artificial Sequence: Synthetic polynucleotide
gaaattgtgttgacgcagtctccatcctccctgtctgcatctgtaggagacagagtcaccatcacttgccgggcaagtcggagcattagcagctacttaaattggtatcagcagaaaccagggaaagcccctaacctcctgatctatgatgcatccactttgcaaagtggggtcccatcaaggttcagtggcagtggatctgggacagatttcagcctcaccatcagcagtctgcaacctgaagattttgcaacttactactgtctacacacttacacaacccctcgcacgttcggccaagggaccaaggtggagatcaaa

SEQ ID NO: 13821-13901 - skipped (81 entries)

SEQ ID NO: 13902 - protein, 121 aa, Artificial Sequence
  Description of Artificial Sequence: Synthetic polypeptide
EVQLVESGGGLVQPGESLRLSCAASGFNFSPYGMNWVRQAPGKGLEWIAYIISGSGTIYYADSVKGRFTISRDNAQSSLYLQMNSLRAEDTAVYYCARGLLDYLHDAFDIWGQGTMVTVSS

SEQ ID NO: 13903 - protein, 26 aa, Artificial Sequence
  Description of Artificial Sequence: Synthetic peptide
EVQLVESGGGLVQPGESLRLSCAASG

SEQ ID NO: 13904 - protein, 9 aa, Artificial Sequence
  Description of Artificial Sequence: Synthetic peptide
FNFSPYGMN

SEQ ID NO: 13905 - protein, 14 aa, Artificial Sequence
  Description of Artificial Sequence: Synthetic peptide
WVRQAPGKGLEWIA

SEQ ID NO: 13906 - protein, 17 aa, Artificial Sequence
  Description of Artificial Sequence: Synthetic peptide
YIISGSGTIYYADSVKG

SEQ ID NO: 13907 - protein, 30 aa, Artificial Sequence
  Description of Artificial Sequence: Synthetic polypeptide
RFTISRDNAQSSLYLQMNSLRAEDTAVYYC

SEQ ID NO: 13908 - protein, 14 aa, Artificial Sequence
  Description of Artificial Sequence: Synthetic peptide
ARGLLDYLHDAFDI

SEQ ID NO: 13909 - protein, 11 aa, Artificial Sequence
  Description of Artificial Sequence: Synthetic peptide
WGQGTMVTVSS

SEQ ID NO: 13910 - DNA, 363 bp, Artificial Sequence
  Description of Artificial Sequence: Synthetic polynucleotide
gaggtgcagctggtggagtctgggggaggcttggtacagcctggggagtccctgagactctcctgtgcagcctctggattcaacttcagtccctatggcatgaactgggtccgccaggctccagggaaggggctcgagtggattgcatacattattagtggtagtggtaccatatactacgcagactctgtgaagggccgattcaccatctccagagacaatgcccagagctcactgtatctgcaaatgaacagcctgagagccgaggacacggctgtgtattactgtgcgagaggtctcctagactacctccatgatgcttttgatatctggggccaagggacaatggtcaccgtctcttca

SEQ ID NO: 13911 - skipped

SEQ ID NO: 13912 - protein, 108 aa, Artificial Sequence
  Description of Artificial Sequence: Synthetic polypeptide
EIVLTQSPATLSVSPGERITLSCRASHSVSSNLAWYQQKPGQVPRLLIYGASARATGIPARFSGSGSGTEFTLTISSLQSEDFAVYYCQQYNYWPPLTFGGGTKVEIK

SEQ ID NO: 13913 - protein, 23 aa, Artificial Sequence
  Description of Artificial Sequence: Synthetic peptide
EIVLTQSPATLSVSPGERITLSC

SEQ ID NO: 13914 - protein, 11 aa, Artificial Sequence
  Description of Artificial Sequence: Synthetic peptide
RASHSVSSNLA

SEQ ID NO: 13915 - protein, 15 aa, Artificial Sequence
  Description of Artificial Sequence: Synthetic peptide
WYQQKPGQVPRLLIY

SEQ ID NO: 13916 - protein, 7 aa, Artificial Sequence
  Description of Artificial Sequence: Synthetic peptide
GASARAT

SEQ ID NO: 13917 - protein, 32 aa, Artificial Sequence
  Description of Artificial Sequence: Synthetic polypeptide
GIPARFSGSGSGTEFTLTISSLQSEDFAVYYC

SEQ ID NO: 13918 - protein, 10 aa, Artificial Sequence
  Description of Artificial Sequence: Synthetic peptide
QQYNYWPPLT

SEQ ID NO: 13919 - protein, 10 aa, Artificial Sequence
  Description of Artificial Sequence: Synthetic peptide
FGGGTKVEIK

SEQ ID NO: 13920 - DNA, 324 bp, Artificial Sequence
  Description of Artificial Sequence: Synthetic polynucleotide
gaaattgtgttgacacagtctccagccaccctctctgtgtctccaggggaaagaatcaccctctcctgcagggccagtcacagtgttagcagcaacttagcctggtaccagcagaaacctggccaggttcccaggctcctcatctatggtgcatctgccagggccactggtatcccagccaggttcagtggcagtgggtctgggacagagttcactctcaccatcagcagcctgcagtctgaagattttgcagtctattactgtcagcagtataattactggcctccgctcactttcggcggagggaccaaggtggaaatcaaa

SEQ ID NO: 13921-14001 - skipped (81 entries)

SEQ ID NO: 14002 - protein, 123 aa, Artificial Sequence
  Description of Artificial Sequence: Synthetic polypeptide
EVQLQESGPGLVKPSETLSLTCAVSGGSVSSDTDYWGWIRQPPGKGLEWIGSIHDSERTYYDPSLKSRVTISVDTSKNQFSLRLSSVTAADTALYFCASRHLDLLPIGSFDVWGRGTMVTVSS

SEQ ID NO: 14003 - protein, 26 aa, Artificial Sequence
  Description of Artificial Sequence: Synthetic peptide
EVQLQESGPGLVKPSETLSLTCAVSG

SEQ ID NO: 14004 - protein, 11 aa, Artificial Sequence
  Description of Artificial Sequence: Synthetic peptide
GSVSSDTDYWG

SEQ ID NO: 14005 - protein, 14 aa, Artificial Sequence
  Description of Artificial Sequence: Synthetic peptide
WIRQPPGKGLEWIG

SEQ ID NO: 14006 - protein, 16 aa, Artificial Sequence
  Description of Artificial Sequence: Synthetic peptide
SIHDSERTYYDPSLKS

SEQ ID NO: 14007 - protein, 30 aa, Artificial Sequence
  Description of Artificial Sequence: Synthetic polypeptide
RVTISVDTSKNQFSLRLSSVTAADTALYFC

SEQ ID NO: 14008 - protein, 15 aa, Artificial Sequence
  Description of Artificial Sequence: Synthetic peptide
ASRHLDLLPIGSFDV

SEQ ID NO: 14009 - protein, 11 aa, Artificial Sequence
  Description of Artificial Sequence: Synthetic peptide
WGRGTMVTVSS

SEQ ID NO: 14010 - DNA, 369 bp, Artificial Sequence
  Description of Artificial Sequence: Synthetic polynucleotide
gaggtgcagctgcaggagtcgggcccaggactggtgaagccgtcggagaccctgtccctcacctgcgctgtctctggtgggtccgtcagtagtgatactgactactggggctggatccgccagcccccagggaagggactggaatggattgggagtatccacgacagtgagaggacctactatgacccgtccctcaagagtcgagtcaccatctccgtggacacgtcgaagaaccaattctccctgagactgagttctgtgacagccgcagacacggctctatatttttgtgcgagtcgtcatctggatcttctgcctattggttcttttgatgtctggggccgagggacaatggtcaccgtctcttca

SEQ ID NO: 14011 - skipped

SEQ ID NO: 14012 - protein, 107 aa, Artificial Sequence
  Description of Artificial Sequence: Synthetic polypeptide
DIQMTQSPSSLSASVGDRVTITCRASQSISTYLNWYQQKTGKAPELLIYVASSLQSGVPSRFSGSGSGTDFTLTISSLQPEDFATYYCQQSYRFPITFGQGTRLEIK

SEQ ID NO: 14013 - protein, 23 aa, Artificial Sequence
  Description of Artificial Sequence: Synthetic peptide
DIQMTQSPSSLSASVGDRVTITC

SEQ ID NO: 14014 - protein, 11 aa, Artificial Sequence
  Description of Artificial Sequence: Synthetic peptide
RASQSISTYLN

SEQ ID NO: 14015 - protein, 15 aa, Artificial Sequence
  Description of Artificial Sequence: Synthetic peptide
WYQQKTGKAPELLIY

SEQ ID NO: 14016 - protein, 7 aa, Artificial Sequence
  Description of Artificial Sequence: Synthetic peptide
VASSLQS

SEQ ID NO: 14017 - protein, 32 aa, Artificial Sequence; identical to SEQ ID NO: 517
  Description of Artificial Sequence: Synthetic polypeptide

SEQ ID NO: 14018 - protein, 9 aa, Artificial Sequence
  Description of Artificial Sequence: Synthetic peptide
QQSYRFPIT

SEQ ID NO: 14019 - protein, 10 aa, Artificial Sequence
  Description of Artificial Sequence: Synthetic peptide
FGQGTRLEIK

SEQ ID NO: 14020 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagcacctatttaaattggtatcagcagaaaacaggtaaagcccctgaactcctgatctatgttgcatccagtttgcaaagtggagtcccatcaagattcagtggcagtggatctgggacagatttcactctcaccatcagcagtctgcaacctgaagattttgcaacttactactgtcaacagagttaccgtttcccgatcaccttcggccaagggacacgactggagattaaa

SEQ ID NO: 14021-14101 - skipped (81 entries)

SEQ ID NO: 14102 - protein, 125 aa, Artificial Sequence
  Description of Artificial Sequence: Synthetic polypeptide
QVQLLESGGGLVQPGRSLRLSCTASGFRFGDYTMTWFRQAPGKGLEWVGFIRSIAYGGTTEHAASVEGRFIISRDDSKSIAYLQMNSLKAEDTGVYFCTRGSGMFYGSSSGMDVWGQGTTVTVSS

SEQ ID NO: 14103 - protein, 26 aa, Artificial Sequence
  Description of Artificial Sequence: Synthetic peptide
QVQLLESGGGLVQPGRSLRLSCTASG

SEQ ID NO: 14104 - protein, 9 aa, Artificial Sequence
  Description of Artificial Sequence: Synthetic peptide
FRFGDYTMT

SEQ ID NO: 14105 - protein, 14 aa, Artificial Sequence
  Description of Artificial Sequence: Synthetic peptide
WFRQAPGKGLEWVG

SEQ ID NO: 14106 - protein, 19 aa, Artificial Sequence
  Description of Artificial Sequence: Synthetic peptide
FIRSIAYGGTTEHAASVEG

SEQ ID NO: 14107 - protein, 30 aa, Artificial Sequence
  Description of Artificial Sequence: Synthetic polypeptide
RFIISRDDSKSIAYLQMNSLKAEDTGVYFC

SEQ ID NO: 14108 - protein, 16 aa, Artificial Sequence
  Description of Artificial Sequence: Synthetic peptide
TRGSGMFYGSSSGMDV

SEQ ID NO: 14109 - protein, 11 aa, Artificial Sequence
  Description of Artificial Sequence: Synthetic peptide
WGQGTTVTVSS

SEQ ID NO: 14110 - DNA, 375 bp, Artificial Sequence
  Description of Artificial Sequence: Synthetic polynucleotide
caggtgcagctgttggagtctgggggaggcttggtacagccagggcggtccctgagactctcctgtacagcttctggattcaggtttggtgattatactatgacctggttccgccaggctccagggaaggggctggagtgggtaggcttcattagaagtatagcttacggtgggacaacagaacatgccgcgtctgtggaaggcagattcatcatctcaagagatgactccaaaagcatcgcctatctgcaaatgaacagcctgaaagccgaggacacaggcgtgtacttctgtactaggggaagtgggatgttctatggttcatcgagtggcatggacgtctggggccaagggaccacggtcactgtctcctca

SEQ ID NO: 14111 - skipped

SEQ ID NO: 14112 - protein, 108 aa, Artificial Sequence
  Description of Artificial Sequence: Synthetic polypeptide
EIVLTQSPATLSLSPGERATLSCRASQSVGTYLAWYQQKHGQAPRLLISDVSKRATGIPARFSGSGSGTDFTLTITSLEPEDFAVYYCQQRTNWPGATFGPGTKVDIK

SEQ ID NO: 14113 - protein, 23 aa, Artificial Sequence
  Description of Artificial Sequence: Synthetic peptide
EIVLTQSPATLSLSPGERATLSC

SEQ ID NO: 14114 - protein, 11 aa, Artificial Sequence
  Description of Artificial Sequence: Synthetic peptide
RASQSVGTYLA

SEQ ID NO: 14115 - protein, 15 aa, Artificial Sequence
  Description of Artificial Sequence: Synthetic peptide
WYQQKHGQAPRLLIS

SEQ ID NO: 14116 - protein, 7 aa, Artificial Sequence
  Description of Artificial Sequence: Synthetic peptide
DVSKRAT

SEQ ID NO: 14117 - protein, 32 aa, Artificial Sequence
  Description of Artificial Sequence: Synthetic polypeptide
GIPARFSGSGSGTDFTLTITSLEPEDFAVYYC

SEQ ID NO: 14118 - protein, 10 aa, Artificial Sequence
  Description of Artificial Sequence: Synthetic peptide
QQRTNWPGAT

SEQ ID NO: 14119 - protein, 10 aa, Artificial Sequence
  Description of Artificial Sequence: Synthetic peptide
FGPGTKVDIK

SEQ ID NO: 14120 - DNA, 324 bp, Artificial Sequence
  Description of Artificial Sequence: Synthetic polynucleotide
gaaattgtattgacgcagtctccagccaccctgtctttgtctccaggggaaagagccaccctctcttgcagggccagtcagagtgttggcacctacttagcctggtaccaacagaaacatggccaggctcccaggctcctcatctctgatgtatccaagagggccactggcatcccagccaggttcagtggcagtgggtctgggacagacttcactctcaccatcaccagcctagagccggaagattttgcagtttattactgtcagcagcgtaccaactggcccggggccactttcggccctgggaccaaagtggatatcaaa

SEQ ID NO: 14121-14201 - skipped (81 entries)

SEQ ID NO: 14202 - protein, 121 aa, Artificial Sequence
  Description of Artificial Sequence: Synthetic polypeptide
EVQLLESGAEVKKPGSSVKVSCKTSGGTFNSYTISWVRQAPGQGLEWMGGIIPILDTPHYAQKFRGRVTITADKSTSTAFMDLSSLTSEDTAVYYCAIRRDYSDYRDFDYWGQGTLVTVSS

SEQ ID NO: 14203 - protein, 26 aa, Artificial Sequence
  Description of Artificial Sequence: Synthetic peptide
EVQLLESGAEVKKPGSSVKVSCKTSG

SEQ ID NO: 14204 - protein, 9 aa, Artificial Sequence
  Description of Artificial Sequence: Synthetic peptide
GTFNSYTIS

SEQ ID NO: 14205 - protein, 14 aa, Artificial Sequence
  Description of Artificial Sequence: Synthetic peptide
WVRQAPGQGLEWMG

SEQ ID NO: 14206 - protein, 17 aa, Artificial Sequence
  Description of Artificial Sequence: Synthetic peptide
GIIPILDTPHYAQKFRG

SEQ ID NO: 14207 - protein, 30 aa, Artificial Sequence
  Description of Artificial Sequence: Synthetic polypeptide
RVTITADKSTSTAFMDLSSLTSEDTAVYYC

SEQ ID NO: 14208 - protein, 14 aa, Artificial Sequence
  Description of Artificial Sequence: Synthetic peptide
AIRRDYSDYRDFDY

SEQ ID NO: 14209 - protein, 11 aa, Artificial Sequence
  Description of Artificial Sequence: Synthetic peptide
WGQGTLVTVSS

SEQ ID NO: 14210 - DNA, 363 bp, Artificial Sequence
  Description of Artificial Sequence: Synthetic polynucleotide
gaggtgcagctgttggagtctggggctgaggtgaagaagcctgggtcctcggtgaaggtctcctgcaagacttctggaggcaccttcaacagttatactatcagctgggtgcggcaggcccctggacaagggcttgagtggatgggagggatcatccctatccttgacacaccacactacgcacagaaattccggggcagagtcaccattaccgcggacaagtccacgagcacagccttcatggacctgagcagcctgacatctgaggacacggccgtgtattactgtgcgattcgccgcgactacagtgactaccgagactttgactactggggccagggaaccctggtcaccgtctcctca

SEQ ID NO: 14211 - skipped

SEQ ID NO: 14212 - protein, 111 aa, Artificial Sequence
  Description of Artificial Sequence: Synthetic polypeptide
QPVLTQSPSASASLGGSVKLTCTLTSGHSTYAIAWHQQQPEKGPRFLMKLNSDGSHNKGDGIPDRFSGSSSGAERYLTISSLQSEDEADYYCHTWGTDIQVFGGGTKLTVL

SEQ ID NO: 14213 - protein, 22 aa, Artificial Sequence
  Description of Artificial Sequence: Synthetic peptide
QPVLTQSPSASASLGGSVKLTC

SEQ ID NO: 14214 - protein, 12 aa, Artificial Sequence
  Description of Artificial Sequence: Synthetic peptide
TLTSGHSTYAIA

SEQ ID NO: 14215 - protein, 15 aa, Artificial Sequence
  Description of Artificial Sequence: Synthetic peptide
WHQQQPEKGPRFLMK

SEQ ID NO: 14216 - protein, 11 aa, Artificial Sequence
  Description of Artificial Sequence: Synthetic peptide
LNSDGSHNKGD

SEQ ID NO: 14217 - protein, 32 aa, Artificial Sequence
  Description of Artificial Sequence: Synthetic polypeptide
GIPDRFSGSSSGAERYLTISSLQSEDEADYYC

SEQ ID NO: 14218 - protein, 9 aa, Artificial Sequence
  Description of Artificial Sequence: Synthetic peptide
HTWGTDIQV

SEQ ID NO: 14219 - protein, 10 aa, Artificial Sequence
  Description of Artificial Sequence: Synthetic peptide
FGGGTKLTVL

SEQ ID NO: 14220 - DNA, 333 bp, Artificial Sequence
  Description of Artificial Sequence: Synthetic polynucleotide
cagcctgtgctgactcaatcgccctctgcctctgcctccctgggaggctcggtcaagctcacctgcactctgaccagtggacacagcacctacgccatcgcatggcatcaacaacagccagagaagggccctcggttcctgatgaagcttaatagtgatggcagccacaacaagggggacgggatccctgatcgcttctcaggctccagctctggggctgagcgctacctcaccatctccagcctccagtctgaggatgaggctgactattactgtcacacctggggcactgacattcaggtatttggcggagggaccaagctgaccgtccta

SEQ ID NO: 14221-14301 - skipped (81 entries)

SEQ ID NO: 14302 - protein, 121 aa, Artificial Sequence
  Description of Artificial Sequence: Synthetic polypeptide
EVQLVESGPGLVKPSETLSLACTVSGGSISNYYWNWVRQPPGKGLEWIGNIYYSGSTTFNPSLKSRVTISVDTSRNQFSLKLSSVTAADTAVYYCARQSSSWYNPYYFDQWGQGTLVTVSS

SEQ ID NO: 14303 - protein, 26 aa, Artificial Sequence
  Description of Artificial Sequence: Synthetic peptide
EVQLVESGPGLVKPSETLSLACTVSG

SEQ ID NO: 14304 - protein, 9 aa, Artificial Sequence
  Description of Artificial Sequence: Synthetic peptide
GSISNYYWN

SEQ ID NO: 14305 - protein, 14 aa, Artificial Sequence
  Description of Artificial Sequence: Synthetic peptide
WVRQPPGKGLEWIG

SEQ ID NO: 14306 - protein, 16 aa, Artificial Sequence
  Description of Artificial Sequence: Synthetic peptide
NIYYSGSTTFNPSLKS

SEQ ID NO: 14307 - protein, 30 aa, Artificial Sequence
  Description of Artificial Sequence: Synthetic polypeptide
RVTISVDTSRNQFSLKLSSVTAADTAVYYC

SEQ ID NO: 14308 - protein, 15 aa, Artificial Sequence
  Description of Artificial Sequence: Synthetic peptide
ARQSSSWYNPYYFDQ

SEQ ID NO: 14309 - protein, 11 aa, Artificial Sequence
  Description of Artificial Sequence: Synthetic peptide
WGQGTLVTVSS

SEQ ID NO: 14310 - DNA, 363 bp, Artificial Sequence
  Description of Artificial Sequence: Synthetic polynucleotide
gaggtgcagctggtggagtcgggcccgggactggtgaagccttcggagaccctgtccctcgcctgcactgtctctggtggctccatcagcaattactactggaactgggtccggcagccccccgggaagggactggagtggattgggaatatctattacagtgggagcaccaccttcaacccctccctcaagagtcgagtcaccatatcagtagacacgtccaggaaccagttctccttgaagctgagctctgtgaccgctgcggacacggccgtctattactgtgcgagacagagcagcagctggtacaatccgtattactttgaccagtggggccagggaaccctggtcaccgtctcctca

SEQ ID NO: 14311 - skipped

SEQ ID NO: 14312 - protein, 110 aa, Artificial Sequence
  Description of Artificial Sequence: Synthetic polypeptide
NFMLTQPHSVSESPGKTVTISCTRSSGSIANNYVQWLQQRPGSSPTTIIYEDNQRPSGVPDRFSGSIDASSNSASLTISGLKTEDEADYYCQSYDSSSQVFGGGTKVTVL

SEQ ID NO: 14313 - protein, 22 aa, Artificial Sequence
  Description of Artificial Sequence: Synthetic peptide
NFMLTQPHSVSESPGKTVTISC

SEQ ID NO: 14314 - protein, 13 aa, Artificial Sequence
  Description of Artificial Sequence: Synthetic peptide
TRSSGSIANNYVQ

SEQ ID NO: 14315 - protein, 15 aa, Artificial Sequence
  Description of Artificial Sequence: Synthetic peptide
WLQQRPGSSPTTIIY

SEQ ID NO: 14316 - protein, 7 aa, Artificial Sequence
  Description of Artificial Sequence: Synthetic peptide
EDNQRPS

SEQ ID NO: 14317 - protein, 34 aa, Artificial Sequence
  Description of Artificial Sequence: Synthetic polypeptide
GVPDRFSGSIDASSNSASLTISGLKTEDEADYYC

SEQ ID NO: 14318 - protein, 9 aa, Artificial Sequence
  Description of Artificial Sequence: Synthetic peptide
QSYDSSSQV

SEQ ID NO: 14319 - protein, 10 aa, Artificial Sequence
  Description of Artificial Sequence: Synthetic peptide
FGGGTKVTVL

SEQ ID NO: 14320 - DNA, 330 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattgccaacaactatgtgcagtggctccaacagcgcccgggcagctcccccaccactatcatctatgaggataaccaaagaccctctggggtccctgatcggttctctggctccattgatgcctcctccaattctgcctccctcaccatctctggactgaagactgaggacgaggctgactactactgtcagtcttatgatagcagcagtcaggtattcggcggagggaccaaggtgaccgtccta

SEQ ID NO: 14321-14401 - skipped (81 entries)

SEQ ID NO: 14402 - protein, 121 aa, Artificial Sequence
  Description of Artificial Sequence: Synthetic polypeptide
QVQLVQSGGGLVQPGESLRLSCAASGFNFSPYGMNWVRQAPGKGLEWIAYIISGSGTIYYADSVKGRFTISRDNAQSSLYLQMNSLRAEDTAVYYCARGLLDYLHDAFDIWGQGTMVTVSS

SEQ ID NO: 14403 - protein, 26 aa, Artificial Sequence
  Description of Artificial Sequence: Synthetic peptide
QVQLVQSGGGLVQPGESLRLSCAASG

SEQ ID NO: 14404 - protein, 9 aa, Artificial Sequence
  Description of Artificial Sequence: Synthetic peptide
FNFSPYGMN

SEQ ID NO: 14405 - protein, 14 aa, Artificial Sequence
  Description of Artificial Sequence: Synthetic peptide
WVRQAPGKGLEWIA

SEQ ID NO: 14406 - protein, 17 aa, Artificial Sequence
  Description of Artificial Sequence: Synthetic peptide
YIISGSGTIYYADSVKG

SEQ ID NO: 14407 - protein, 30 aa, Artificial Sequence; identical to SEQ ID NO: 13907
  Description of Artificial Sequence: Synthetic polypeptide

SEQ ID NO: 14408 - protein, 14 aa, Artificial Sequence
  Description of Artificial Sequence: Synthetic peptide
ARGLLDYLHDAFDI

SEQ ID NO: 14409 - protein, 11 aa, Artificial Sequence
  Description of Artificial Sequence: Synthetic peptide
WGQGTMVTVSS

SEQ ID NO: 14410 - DNA, 363 bp, Artificial Sequence
  Description of Artificial Sequence: Synthetic polynucleotide
caggtccagctggtacagtctgggggaggcttggtacagcctggggagtccctgagactctcctgtgcagcctctggattcaacttcagtccctatggcatgaactgggtccgccaggctccagggaaggggctcgagtggattgcatacattattagtggtagtggtaccatatactacgcagactctgtgaagggccgattcaccatctccagagacaatgcccagagctcactgtatctgcaaatgaacagcctgagagccgaggacacggctgtgtattactgtgcgagaggtctcctagactacctccatgatgcttttgatatctggggccaagggacaatggtcaccgtctcctca

SEQ ID NO: 14411 - skipped

SEQ ID NO: 14412 - protein, 108 aa, Artificial Sequence
  Description of Artificial Sequence: Synthetic polypeptide
DIVLTQSPATLSVSPGERITLSCRASHSVSSNLAWYQQKPGQVPRLLIYGASARATGIPARFSGSGSGTEFTLTISSLQSEDFAVYYCQQYNYWPPLTFGGGTKVEIK

SEQ ID NO: 14413 - protein, 23 aa, Artificial Sequence
  Description of Artificial Sequence: Synthetic peptide
DIVLTQSPATLSVSPGERITLSC

SEQ ID NO: 14414 - protein, 11 aa, Artificial Sequence
  Description of Artificial Sequence: Synthetic peptide
RASHSVSSNLA

SEQ ID NO: 14415 - protein, 15 aa, Artificial Sequence
  Description of Artificial Sequence: Synthetic peptide
WYQQKPGQVPRLLIY

SEQ ID NO: 14416 - protein, 7 aa, Artificial Sequence
  Description of Artificial Sequence: Synthetic peptide
GASARAT

SEQ ID NO: 14417 - protein, 32 aa, Artificial Sequence; identical to SEQ ID NO: 13917
  Description of Artificial Sequence: Synthetic polypeptide

SEQ ID NO: 14418 - protein, 10 aa, Artificial Sequence
  Description of Artificial Sequence: Synthetic peptide
QQYNYWPPLT

SEQ ID NO: 14419 - protein, 10 aa, Artificial Sequence
  Description of Artificial Sequence: Synthetic peptide
FGGGTKVEIK

SEQ ID NO: 14420 - DNA, 324 bp, Artificial Sequence
  Description of Artificial Sequence: Synthetic polynucleotide
gatattgtgctgactcagtctccagccaccctctctgtgtctccaggggaaagaatcaccctctcctgcagggccagtcacagtgttagcagcaacttagcctggtaccagcagaaacctggccaggttcccaggctcctcatctatggtgcatctgccagggccactggtatcccagccaggttcagtggcagtgggtctgggacagagttcactctcaccatcagcagcctgcagtctgaagattttgcagtctattactgtcagcagtataattactggcctccgctcactttcggcggagggaccaaggtggagatcaaa

SEQ ID NO: 14421-14501 - skipped (81 entries)

SEQ ID NO: 14502 - protein, 126 aa, Artificial Sequence
  Description of Artificial Sequence: Synthetic polypeptide
EVQLVESGAEVKNPGSSVKISCKSSGGTLGDYAISWVRQAPGLGLEWLGGIMPLHGTTGYSQRFRPRLTITADESARTAYMELTALSSEDSAIYYCARDPSILNTGNHHWYDLDLWGQGTEVTVSS

SEQ ID NO: 14503 - protein, 26 aa, Artificial Sequence
  Description of Artificial Sequence: Synthetic peptide
EVQLVESGAEVKNPGSSVKISCKSSG

SEQ ID NO: 14504 - protein, 9 aa, Artificial Sequence
  Description of Artificial Sequence: Synthetic peptide
GTLGDYAIS

SEQ ID NO: 14505 - protein, 14 aa, Artificial Sequence
  Description of Artificial Sequence: Synthetic peptide
WVRQAPGLGLEWLG

SEQ ID NO: 14506 - protein, 17 aa, Artificial Sequence
  Description of Artificial Sequence: Synthetic peptide
GIMPLHGTTGYSQRFRP

SEQ ID NO: 14507 - protein, 30 aa, Artificial Sequence
  Description of Artificial Sequence: Synthetic polypeptide
RLTITADESARTAYMELTALSSEDSAIYYC

SEQ ID NO: 14508 - protein, 19 aa, Artificial Sequence
  Description of Artificial Sequence: Synthetic peptide
ARDPSILNTGNHHWYDLDL

SEQ ID NO: 14509 - protein, 11 aa, Artificial Sequence
  Description of Artificial Sequence: Synthetic peptide
WGQGTEVTVSS

SEQ ID NO: 14510 - DNA, 378 bp, Artificial Sequence
  Description of Artificial Sequence: Synthetic polynucleotide
gaggtgcagctggtggagtctggggctgaggtgaagaaccctgggtcctcggtgaaaatctcctgcaagtcttctggaggcaccctcggtgactatgctatcagttgggtgcgccaggcccctggactggggcttgagtggctgggggggatcatgcctctccatggaacgacaggctactcacagcgtttccggcccagactcacaatcaccgcggacgaatccgcgagaacagcctatatggagctgaccgccctgagctctgaggactcggccatatattactgtgcgagagatccgtctattcttaacactggaaatcatcactggtatgatttggatctctggggccaagggacagaggtcaccgtctcctca

SEQ ID NO: 14511 - skipped

SEQ ID NO: 14512 - protein, 112 aa, Artificial Sequence
  Description of Artificial Sequence: Synthetic polypeptide
ETTLTQSPLSLSVTLGQAASISCRPNLGLMHTDGNTYLNWFHQRPGQSPRRLIYKVSNRDSGVPDRFAGSGSGTHFTLEISGVEADDVGVYYCMQGTEWPRTFGQGTKLEIK

SEQ ID NO: 14513 - protein, 23 aa, Artificial Sequence
  Description of Artificial Sequence: Synthetic peptide
ETTLTQSPLSLSVTLGQAASISC

SEQ ID NO: 14514 - protein, 16 aa, Artificial Sequence
  Description of Artificial Sequence: Synthetic peptide
RPNLGLMHTDGNTYLN

SEQ ID NO: 14515 - protein, 15 aa, Artificial Sequence
  Description of Artificial Sequence: Synthetic peptide
WFHQRPGQSPRRLIY

SEQ ID NO: 14516 - protein, 7 aa, Artificial Sequence
  Description of Artificial Sequence: Synthetic peptide
KVSNRDS

SEQ ID NO: 14517 - protein, 32 aa, Artificial Sequence
  Description of Artificial Sequence: Synthetic polypeptide
GVPDRFAGSGSGTHFTLEISGVEADDVGVYYC

SEQ ID NO: 14518 - protein, 9 aa, Artificial Sequence
  Description of Artificial Sequence: Synthetic peptide
MQGTEWPRT

SEQ ID NO: 14519 - protein, 10 aa, Artificial Sequence
  Description of Artificial Sequence: Synthetic peptide
FGQGTKLEIK

SEQ ID NO: 14520 - DNA, 336 bp, Artificial Sequence
  Description of Artificial Sequence: Synthetic polynucleotide
gaaacgacactcacgcagtctccactctccctgtccgtcacccttggacaggcggcctccatctcctgcaggcctaatctaggcctcatgcacactgatggaaacacctacttgaattggtttcaccagaggccaggccaatctccaaggcgcctaatttataaggtttctaaccgggactctggggtcccagacagattcgccggcagtgggtcaggcactcatttcacactggaaatcagcggggtggaggctgatgatgttggggtttattactgcatgcaaggtacagagtggcctcggacgttcggccaagggaccaagctggagatcaaa

SEQ ID NO: 14521-14601 - skipped (81 entries)

SEQ ID NO: 14602 - protein, 121 aa, Artificial Sequence
  Description of Artificial Sequence: Synthetic polypeptide
EVQLLESGGGVVQPGRSLRLSCAASGFTFNSYALFWVRQAPGKGLEWVAVVSYDGNNKYYADSVKGRFTISRDNSKNTLYLQMNSLKTEDTSVYYCARPRSGSYRQAIDYWGLGTLVTVSS

SEQ ID NO: 14603 - protein, 26 aa, Artificial Sequence
  Description of Artificial Sequence: Synthetic peptide
EVQLLESGGGVVQPGRSLRLSCAASG

SEQ ID NO: 14604 - protein, 9 aa, Artificial Sequence
  Description of Artificial Sequence: Synthetic peptide
FTFNSYALF

SEQ ID NO: 14605 - protein, 14 aa, Artificial Sequence
  Description of Artificial Sequence: Synthetic peptide
WVRQAPGKGLEWVA

SEQ ID NO: 14606 - protein, 17 aa, Artificial Sequence
  Description of Artificial Sequence: Synthetic peptide
VVSYDGNNKYYADSVKG

SEQ ID NO: 14607 - protein, 30 aa, Artificial Sequence
  Description of Artificial Sequence: Synthetic polypeptide
RFTISRDNSKNTLYLQMNSLKTEDTSVYYC

SEQ ID NO: 14608 - protein, 14 aa, Artificial Sequence
  Description of Artificial Sequence: Synthetic peptide
ARPRSGSYRQAIDY

SEQ ID NO: 14609 - protein, 11 aa, Artificial Sequence
  Description of Artificial Sequence: Synthetic peptide
WGLGTLVTVSS

SEQ ID NO: 14610 - DNA, 363 bp, Artificial Sequence
  Description of Artificial Sequence: Synthetic polynucleotide
gaggtgcagctgttggagtctgggggaggcgtggtccagcctgggaggtccctgagactctcctgtgcagcctctggattcaccttcaatagctatgctctgttctgggtccgccaggctccaggcaaggggctggagtgggtggcagttgtatcatatgatggaaacaataaatactacgcagactccgtgaagggccgattcaccatctccagagacaattccaagaacacgctgtatctgcaaatgaacagcctgaaaactgaggacacgtctgtgtattactgtgcgagaccccgttcggggagttaccgtcaggccattgactactggggcctgggaaccctggtcaccgtctcctca

SEQ ID NO: 14611 - skipped

SEQ ID NO: 14612 - protein, 106 aa, Artificial Sequence
  Description of Artificial Sequence: Synthetic polypeptide
DIRMTQSPSTLSASVGDRVTITCRASQTIGSWLAWYQQKPGKAPNLLIYKASSLESGVPSRFSGSGSGTEFTLTISSLQPDDFATYYCQQYNSLYTFGQGTKLEIK

SEQ ID NO: 14613 - protein, 23 aa, Artificial Sequence
  Description of Artificial Sequence: Synthetic peptide
DIRMTQSPSTLSASVGDRVTITC

SEQ ID NO: 14614 - protein, 11 aa, Artificial Sequence
  Description of Artificial Sequence: Synthetic peptide
RASQTIGSWLA

SEQ ID NO: 14615 - protein, 15 aa, Artificial Sequence
  Description of Artificial Sequence: Synthetic peptide
WYQQKPGKAPNLLIY

SEQ ID NO: 14616 - protein, 7 aa, Artificial Sequence
  Description of Artificial Sequence: Synthetic peptide
KASSLES

SEQ ID NO: 14617 - protein, 32 aa, Artificial Sequence; identical to SEQ ID NO: 6717
  Description of Artificial Sequence: Synthetic polypeptide

SEQ ID NO: 14618 - protein, 8 aa, Artificial Sequence
  Description of Artificial Sequence: Synthetic peptide
QQYNSLYT

SEQ ID NO: 14619 - protein, 10 aa, Artificial Sequence
  Description of Artificial Sequence: Synthetic peptide
FGQGTKLEIK

SEQ ID NO: 14620 - DNA, 318 bp, Artificial Sequence
  Description of Artificial Sequence: Synthetic polynucleotide
gacatccggatgacccagtctccttccaccctgtctgcatctgtaggagacagagtcaccatcacttgccgggccagtcagactattggtagctggttggcctggtatcagcagaaaccagggaaagcccctaacctcctgatctataaggcgtctagtttagaaagtggggtcccatcaaggttcagcggcagtggatctgggacagaattcactctcaccatcagcagcctgcagcctgatgattttgcaacttattactgccaacagtataatagtctgtacacttttggccaggggaccaagctggagatcaaa

SEQ ID NO: 14621-14701 - skipped (81 entries)

SEQ ID NO: 14702 - protein, 123 aa, Artificial Sequence
  Description of Artificial Sequence: Synthetic polypeptide
QVQLVQSGGGLVQPGGSLRLSCAASGFIFSGHWMSWVRQAPGKGLEWVANIKQDGREKHYVDSVKGRFTISRDNAKNSVSLQMNSLRAEDTAVYYCVRQNVAIQYYYYAMDVWGQGTTVTVSS

SEQ ID NO: 14703 - protein, 26 aa, Artificial Sequence
  Description of Artificial Sequence: Synthetic peptide
QVQLVQSGGGLVQPGGSLRLSCAASG

SEQ ID NO: 14704 - protein, 9 aa, Artificial Sequence
  Description of Artificial Sequence: Synthetic peptide
FIFSGHWMS

SEQ ID NO: 14705 - protein, 14 aa, Artificial Sequence
  Description of Artificial Sequence: Synthetic peptide
WVRQAPGKGLEWVA

SEQ ID NO: 14706 - protein, 17 aa, Artificial Sequence
  Description of Artificial Sequence: Synthetic peptide
NIKQDGREKHYVDSVKG

SEQ ID NO: 14707 - protein, 30 aa, Artificial Sequence
  Description of Artificial Sequence: Synthetic polypeptide
RFTISRDNAKNSVSLQMNSLRAEDTAVYYC

SEQ ID NO: 14708 - protein, 16 aa, Artificial Sequence
  Description of Artificial Sequence: Synthetic peptide
VRQNVAIQYYYYAMDV

SEQ ID NO: 14709 - protein, 11 aa, Artificial Sequence
  Description of Artificial Sequence: Synthetic peptide
WGQGTTVTVSS

SEQ ID NO: 14710 - DNA, 369 bp, Artificial Sequence
  Description of Artificial Sequence: Synthetic polynucleotide
caggtccagcttgtgcagtctgggggaggcttggtccagcctggggggtccctgagactctcctgtgcagcctctggattcatatttagtggccactggatgagttgggtccgccaggctccagggaaggggctggagtgggtggccaatattaagcaagatggaagagagaaacattatgtggactctgtgaagggccgattcaccatctccagagacaacgccaagaactcagtgtctctacaaatgaacagcctcagagccgaggacacggctgtatattactgtgtgagacaaaacgtggctattcaatactactactacgccatggacgtctggggccaggggaccacggtcaccgtctcctca

SEQ ID NO: 14711 - skipped

SEQ ID NO: 14712 - protein, 108 aa, Artificial Sequence
  Description of Artificial Sequence: Synthetic polypeptide
ETTLTQSPGTLSVSPGERATLSCRASQSVISNLAWYQQKPGQAPRLLIYGASTRATGVPARFSGSGSGTEFTLTIASLQSEDFAVYYCQQYHHWPPYTFGQGTKVDIK

SEQ ID NO: 14713 - protein, 23 aa, Artificial Sequence
  Description of Artificial Sequence: Synthetic peptide
ETTLTQSPGTLSVSPGERATLSC

SEQ ID NO: 14714 - protein, 11 aa, Artificial Sequence
  Description of Artificial Sequence: Synthetic peptide
RASQSVISNLA

SEQ ID NO: 14715 - protein, 15 aa, Artificial Sequence
  Description of Artificial Sequence: Synthetic peptide
WYQQKPGQAPRLLIY

SEQ ID NO: 14716 - protein, 7 aa, Artificial Sequence
  Description of Artificial Sequence: Synthetic peptide
GASTRAT

SEQ ID NO: 14717 - protein, 32 aa, Artificial Sequence
  Description of Artificial Sequence: Synthetic polypeptide
GVPARFSGSGSGTEFTLTIASLQSEDFAVYYC

SEQ ID NO: 14718 - protein, 10 aa, Artificial Sequence
  Description of Artificial Sequence: Synthetic peptide
QQYHHWPPYT

SEQ ID NO: 14719 - protein, 10 aa, Artificial Sequence
  Description of Artificial Sequence: Synthetic peptide
FGQGTKVDIK

SEQ ID NO: 14720 - DNA, 324 bp, Artificial Sequence
  Description of Artificial Sequence: Synthetic polynucleotide
gaaacgacactcacgcagtctccaggcaccctgtctgtgtctccaggggaaagagccaccctctcctgcagggccagtcagagtgtcatcagcaacttagcctggtaccagcagaaacctggccaggctcccaggctcctcatctatggtgcatccaccagggccactggtgtcccagccaggttcagtggcagtgggtctgggacagagttcactctcaccatcgccagcctgcagtctgaggattttgcagtttattactgtcagcagtatcatcactggcctccgtacacttttggccaggggaccaaagtggatatcaaa

SEQ ID NO: 14721-14801 - skipped (81 entries)

SEQ ID NO: 14802 - protein, 126 aa, Artificial Sequence
  Description of Artificial Sequence: Synthetic polypeptide
QVQLVESGAEVKKPGSSVKVSCKASGGTLSDYAISWVRQAPGQGLEWMGGIMPIFGSPGYAEIFQGRVTITADESKSTVYMELTSLRSEDTAVYYCARDPSILDTGNHHWYDLDIWGQGTMVTVSS

SEQ ID NO: 14803 - protein, 26 aa, Artificial Sequence
  Description of Artificial Sequence: Synthetic peptide
QVQLVESGAEVKKPGSSVKVSCKASG

SEQ ID NO: 14804 - protein, 9 aa, Artificial Sequence
  Description of Artificial Sequence: Synthetic peptide
GTLSDYAIS

SEQ ID NO: 14805 - protein, 14 aa, Artificial Sequence
  Description of Artificial Sequence: Synthetic peptide
WVRQAPGQGLEWMG

SEQ ID NO: 14806 - protein, 17 aa, Artificial Sequence
  Description of Artificial Sequence: Synthetic peptide
GIMPIFGSPGYAEIFQG

SEQ ID NO: 14807 - protein, 30 aa, Artificial Sequence
  Description of Artificial Sequence: Synthetic polypeptide
RVTITADESKSTVYMELTSLRSEDTAVYYC

SEQ ID NO: 14808 - protein, 19 aa, Artificial Sequence
  Description of Artificial Sequence: Synthetic peptide
ARDPSILDTGNHHWYDLDI

SEQ ID NO: 14809 - protein, 11 aa, Artificial Sequence
  Description of Artificial Sequence: Synthetic peptide
WGQGTMVTVSS

SEQ ID NO: 14810 - DNA, 378 bp, Artificial Sequence
  Description of Artificial Sequence: Synthetic polynucleotide
caggtgcagctggtggagtctggggctgaggtgaagaagcctgggtcctcagtgaaggtctcctgtaaggcttctggaggcaccctcagtgattacgccatcagctgggtgcgacaggcccctggacaagggcttgagtggatgggagggatcatgcctatctttggttcgccaggctacgcagaaattttccagggcagagtcacgattaccgcggacgaatccaagagtacagtctacatggaattgaccagcctgaggtctgaggacacggccgtatattactgtgcgagagatccgtctattcttgatactgggaatcaccactggtatgatctagatatctggggccaagggacaatggtcaccgtctcttca

SEQ ID NO: 14811 - skipped

SEQ ID NO: 14812 - protein, 112 aa, Artificial Sequence
  Description of Artificial Sequence: Synthetic polypeptide
EIVMTQSPLSLPVSLGQPASISCRSSQSVIHTDGNTYLNWYHQRPGQSPRRLIYKVSNRDSGVPDRFSGSGSVTDFTLKISRVEAEDVGVYYCMQGTEWPRTFGQGTKVEIK

SEQ ID NO: 14813 - protein, 23 aa, Artificial Sequence
  Description of Artificial Sequence: Synthetic peptide
EIVMTQSPLSLPVSLGQPASISC

SEQ ID NO: 14814 - protein, 16 aa, Artificial Sequence
  Description of Artificial Sequence: Synthetic peptide
RSSQSVIHTDGNTYLN

SEQ ID NO: 14815 - protein, 15 aa, Artificial Sequence
  Description of Artificial Sequence: Synthetic peptide
WYHQRPGQSPRRLIY

SEQ ID NO: 14816 - protein, 7 aa, Artificial Sequence
  Description of Artificial Sequence: Synthetic peptide
KVSNRDS

SEQ ID NO: 14817 - protein, 32 aa, Artificial Sequence
  Description of Artificial Sequence: Synthetic polypeptide
GVPDRFSGSGSVTDFTLKISRVEAEDVGVYYC

SEQ ID NO: 14818 - protein, 9 aa, Artificial Sequence
  Description of Artificial Sequence: Synthetic peptide
MQGTEWPRT

SEQ ID NO: 14819 - protein, 10 aa, Artificial Sequence
  Description of Artificial Sequence: Synthetic peptide
FGQGTKVEIK

SEQ ID NO: 14820 - DNA, 336 bp, Artificial Sequence
  Description of Artificial Sequence: Synthetic polynucleotide
gaaattgtaatgacacagtctccactctccctgcccgtcagcctcggacagccggcctccatctcctgcaggtctagtcaaagcgtcatacacactgatgggaacacgtacttgaattggtatcaccagaggccaggccaatctccaaggcgcctaatttataaggtttctaacagggactccggggtcccagacagattcagcggcagtgggtcagtcactgatttcacactgaaaatcagcagggtggaggctgaggatgttggcgtttattactgcatgcaaggtacagagtggcctcggacgttcggccaagggaccaaggtggaaatcaaa

SEQ ID NO: 14821-14901 - skipped (81 entries)

SEQ ID NO: 14902 - protein, 124 aa, Artificial Sequence
  Description of Artificial Sequence: Synthetic polypeptide
QVQLVQSGAEVKKPGSSVKVSCKTSGATYKNSAFSWARQAPGQGFQWMGGIIPLFGVPHYVQMFQGRVTITADESTSAVYMELSGLTSDDTAVYYCAREEYSGTVHNFFGMDVWGQGTTVTVSS

SEQ ID NO: 14903 - protein, 26 aa, Artificial Sequence
  Description of Artificial Sequence: Synthetic peptide
QVQLVQSGAEVKKPGSSVKVSCKTSG

SEQ ID NO: 14904 - protein, 9 aa, Artificial Sequence
  Description of Artificial Sequence: Synthetic peptide
ATYKNSAFS

SEQ ID NO: 14905 - protein, 14 aa, Artificial Sequence
  Description of Artificial Sequence: Synthetic peptide
WARQAPGQGFQWMG

SEQ ID NO: 14906 - protein, 17 aa, Artificial Sequence
  Description of Artificial Sequence: Synthetic peptide
GIIPLFGVPHYVQMFQG

SEQ ID NO: 14907 - protein, 30 aa, Artificial Sequence
  Description of Artificial Sequence: Synthetic polypeptide
RVTITADESTSAVYMELSGLTSDDTAVYYC

SEQ ID NO: 14908 - protein, 17 aa, Artificial Sequence
  Description of Artificial Sequence: Synthetic peptide
AREEYSGTVHNFFGMDV

SEQ ID NO: 14909 - protein, 11 aa, Artificial Sequence
  Description of Artificial Sequence: Synthetic peptide
WGQGTTVTVSS

SEQ ID NO: 14910 - DNA, 372 bp, Artificial Sequence
  Description of Artificial Sequence: Synthetic polynucleotide
caggtgcagctggtgcagtctggggctgaggtgaagaagcctgggtcctcggtgaaagtctcctgcaagacttccggagccacctataagaattctgcttttagttgggcgcgacaggcccctgggcaaggatttcagtggatgggagggatcatccctttgtttggtgtgccgcactatgtacagatgtttcaaggcagagtcacgatcacagcggacgaatccacgagtgcagtctacatggaattgagcggcctgacctctgacgacacggccgtgtattactgtgcgagagaggagtattcggggactgttcataacttcttcggcatggacgtctggggccaagggaccacggtcaccgtctcctca

SEQ ID NO: 14911 - skipped

SEQ ID NO: 14912 - protein, 112 aa, Artificial Sequence
  Description of Artificial Sequence: Synthetic polypeptide
DIVMTQSPLSLPVSRGQSASISCRSSHSVVHSDGKTYVNWFHQRPGQAPRRLIYQVSKRDSGVPDRFSGSGSGFDFTLKISRVEAEDVGVYFCMQGTDWPRSFGGGTKVDIK

SEQ ID NO: 14913 - protein, 23 aa, Artificial Sequence
  Description of Artificial Sequence: Synthetic peptide
DIVMTQSPLSLPVSRGQSASISC

SEQ ID NO: 14914 - protein, 16 aa, Artificial Sequence
  Description of Artificial Sequence: Synthetic peptide
RSSHSVVHSDGKTYVN

SEQ ID NO: 14915 - protein, 15 aa, Artificial Sequence
  Description of Artificial Sequence: Synthetic peptide
WFHQRPGQAPRRLIY

SEQ ID NO: 14916 - protein, 7 aa, Artificial Sequence
  Description of Artificial Sequence: Synthetic peptide
QVSKRDS

SEQ ID NO: 14917 - protein, 32 aa, Artificial Sequence
  Description of Artificial Sequence: Synthetic polypeptide
GVPDRFSGSGSGFDFTLKISRVEAEDVGVYFC

SEQ ID NO: 14918 - protein, 9 aa, Artificial Sequence
  Description of Artificial Sequence: Synthetic peptide
MQGTDWPRS

SEQ ID NO: 14919 - protein, 10 aa, Artificial Sequence
  Description of Artificial Sequence: Synthetic peptide
FGGGTKVDIK

SEQ ID NO: 14920 - DNA, 336 bp, Artificial Sequence
  Description of Artificial Sequence: Synthetic polynucleotide
gatattgtgatgacgcagtctccactctccctgcccgtcagccgtggacagtcggcctccatctcctgcaggtctagtcacagtgtcgtgcacagtgatggaaaaacctacgtgaattggtttcaccagaggccagggcaagctccaaggcgcctaatttatcaggtttctaagcgggactctggggtcccagacagattcagcggcagtgggtcaggttttgatttcacactgaaaatcagccgggtggaggctgaggatgttggggtttatttctgcatgcaaggtacagactggcctcggtctttcggcggagggaccaaagtggatatcaaa

SEQ ID NO: 14921-15001 - skipped (81 entries)

SEQ ID NO: 15002 - protein, 122 aa, Artificial Sequence
  Description of Artificial Sequence: Synthetic polypeptide
EVQLVESGGGLVQPGGSLRLSCSASEFTLRSHAMHWVRQAPGKGLEYVSGISTDGSGRFYADSVKGRFTISRDNSKNKLFLQMSSLRPEDTAVYYCVRDWGSSTHYDVFDLWGQGTMVTVSS

SEQ ID NO: 15003 - protein, 26 aa, Artificial Sequence
  Description of Artificial Sequence: Synthetic peptide
EVQLVESGGGLVQPGGSLRLSCSASE

SEQ ID NO: 15004 - protein, 9 aa, Artificial Sequence
  Description of Artificial Sequence: Synthetic peptide
FTLRSHAMH

SEQ ID NO: 15005 - protein, 14 aa, Artificial Sequence
  Description of Artificial Sequence: Synthetic peptide
WVRQAPGKGLEYVS

SEQ ID NO: 15006 - protein, 17 aa, Artificial Sequence
  Description of Artificial Sequence: Synthetic peptide
GISTDGSGRFYADSVKG

SEQ ID NO: 15007 - protein, 30 aa, Artificial Sequence
  Description of Artificial Sequence: Synthetic polypeptide
RFTISRDNSKNKLFLQMSSLRPEDTAVYYC

SEQ ID NO: 15008 - protein, 15 aa, Artificial Sequence
  Description of Artificial Sequence: Synthetic peptide
VRDWGSSTHYDVFDL

SEQ ID NO: 15009 - protein, 11 aa, Artificial Sequence
  Description of Artificial Sequence: Synthetic peptide
WGQGTMVTVSS

SEQ ID NO: 15010 - DNA, 366 bp, Artificial Sequence
  Description of Artificial Sequence: Synthetic polynucleotide
gaggtgcagctggtggagtctgggggaggcttggtccagccgggggggtccctgagactctcctgttcagcctctgaattcaccctcaggagccatgctatgcactgggtccgccaggctccagggaagggactggagtatgtctcaggtataagtactgatgggagtgggagattctacgcagactccgtgaagggccgattcaccatctccagagacaattccaagaacaaattgtttcttcaaatgagcagtctgagacctgaggacacggctgtctattactgtgtgagagattggggcagcagcacccattatgatgtttttgatctctggggccaagggacaatggtcaccgtctcctca

SEQ ID NO: 15011 - skipped

SEQ ID NO: 15012 - protein, 108 aa, Artificial Sequence
  Description of Artificial Sequence: Synthetic polypeptide
DIVMTQSPSSLSASVGDRVTITCRASQSINIYLNWYQQKPGKAPKLLIYAASSLQSGVPSRFSGSGSGTDFTLTISSLQPEDFATYYCQQSYSTPLITFGQGTRLEIK

SEQ ID NO: 15013 - protein, 23 aa, Artificial Sequence
  Description of Artificial Sequence: Synthetic peptide
DIVMTQSPSSLSASVGDRVTITC

SEQ ID NO: 15014 - protein, 11 aa, Artificial Sequence
  Description of Artificial Sequence: Synthetic peptide
RASQSINIYLN

SEQ ID NO: 15015 - protein, 15 aa, Artificial Sequence
  Description of Artificial Sequence: Synthetic peptide
WYQQKPGKAPKLLIY

SEQ ID NO: 15016 - protein, 7 aa, Artificial Sequence
  Description of Artificial Sequence: Synthetic peptide
AASSLQS

SEQ ID NO: 15017 - protein, 32 aa, Artificial Sequence; identical to SEQ ID NO: 517
  Description of Artificial Sequence: Synthetic polypeptide

SEQ ID NO: 15018 - protein, 10 aa, Artificial Sequence
  Description of Artificial Sequence: Synthetic peptide
QQSYSTPLIT

SEQ ID NO: 15019 - protein, 10 aa, Artificial Sequence
  Description of Artificial Sequence: Synthetic peptide
FGQGTRLEIK

SEQ ID NO: 15020 - DNA, 324 bp, Artificial Sequence
  Description of Artificial Sequence: Synthetic polynucleotide
gatattgtgatgacccagtctccatcctccctgtctgcatctgtaggagacagagtcaccatcacttgccgggcaagtcagagcattaacatctatttaaattggtatcagcaaaaaccagggaaagcccctaagctcctgatctatgctgcatccagtttgcagagtggggtcccatcaaggttcagtggcagtggatctgggacagatttcactctcaccatcagcagtctgcaacctgaagattttgcaacttactactgtcaacagagttacagtacccctctgatcaccttcggccaagggacacgactggagattaaa

SEQ ID NO: 15021-15101 - skipped (81 entries)

SEQ ID NO: 15102 - protein, 126 aa, Artificial Sequence
  Description of Artificial Sequence: Synthetic polypeptide
QVQLVQSGAEVKKPGSSVKVSCKASGGTLADYAISWVRQAPGQGLEWMGGIKPLHGAAGYSQHFRGRLSITADESASTAYMELTGLRSEDTAMYYCARDPSILNTGNHHWYDLDLWGQGTMVTVSS

SEQ ID NO: 15103 - protein, 26 aa, Artificial Sequence
  Description of Artificial Sequence: Synthetic peptide
QVQLVQSGAEVKKPGSSVKVSCKASG

SEQ ID NO: 15104 - protein, 9 aa, Artificial Sequence
  Description of Artificial Sequence: Synthetic peptide
GTLADYAIS

SEQ ID NO: 15105 - protein, 14 aa, Artificial Sequence
  Description of Artificial Sequence: Synthetic peptide
WVRQAPGQGLEWMG

SEQ ID NO: 15106 - protein, 17 aa, Artificial Sequence
  Description of Artificial Sequence: Synthetic peptide
GIKPLHGAAGYSQHFRG

SEQ ID NO: 15107 - protein, 30 aa, Artificial Sequence
  Description of Artificial Sequence: Synthetic polypeptide
RLSITADESASTAYMELTGLRSEDTAMYYC

SEQ ID NO: 15108 - protein, 19 aa, Artificial Sequence
  Description of Artificial Sequence: Synthetic peptide
ARDPSILNTGNHHWYDLDL

SEQ ID NO: 15109 - protein, 11 aa, Artificial Sequence
  Description of Artificial Sequence: Synthetic peptide
WGQGTMVTVSS

SEQ ID NO: 15110 - DNA, 378 bp, Artificial Sequence
  Description of Artificial Sequence: Synthetic polynucleotide
caggtccagcttgtgcagtctggggctgaggtgaagaagcctgggtcctcggtgaaggtctcctgcaaggcttctggaggcaccctcgctgactatgcaatcagttgggtgcgacaggcccctggacagggacttgagtggatgggggggatcaaacctctccatggtgcggcaggctactcacagcatttccggggcagactctcgattaccgcggacgagtccgcgagcacagcctacatggagctgaccggcctgagatctgaggacacggccatgtattactgtgcgagagatccgtctattcttaatactgggaatcaccactggtatgatttagatctctggggccaagggacaatggtcaccgtctcctca

SEQ ID NO: 15111 - skipped

SEQ ID NO: 15112 - protein, 112 aa, Artificial Sequence
  Description of Artificial Sequence: Synthetic polypeptide
DIRLTQSPLSLPVTLGQAASISCKSSHFIVHTDGNTYLNWFHQRPGQSPRRLIYKVSNRDSGVPDRFSGSGSGTDFTLEISGVEAEDVGVYYCMQGTEWPRTFGQGTKVDIK

SEQ ID NO: 15113 - protein, 23 aa, Artificial Sequence
  Description of Artificial Sequence: Synthetic peptide
DIRLTQSPLSLPVTLGQAASISC

SEQ ID NO: 15114 - protein, 16 aa, Artificial Sequence
  Description of Artificial Sequence: Synthetic peptide
KSSHFIVHTDGNTYLN

SEQ ID NO: 15115 - protein, 15 aa, Artificial Sequence
  Description of Artificial Sequence: Synthetic peptide
WFHQRPGQSPRRLIY

SEQ ID NO: 15116 - protein, 7 aa, Artificial Sequence
  Description of Artificial Sequence: Synthetic peptide
KVSNRDS

SEQ ID NO: 15117 - protein, 32 aa, Artificial Sequence
  Description of Artificial Sequence: Synthetic polypeptide
GVPDRFSGSGSGTDFTLEISGVEAEDVGVYYC

SEQ ID NO: 15118 - protein, 9 aa, Artificial Sequence
  Description of Artificial Sequence: Synthetic peptide
MQGTEWPRT

SEQ ID NO: 15119 - protein, 10 aa, Artificial Sequence
  Description of Artificial Sequence: Synthetic peptide
FGQGTKVDIK

SEQ ID NO: 15120 - DNA, 336 bp, Artificial Sequence
  Description of Artificial Sequence: Synthetic polynucleotide
gacatccggttgacccagtctccactctccctgcccgtcacccttggacaggcggcctccatctcctgcaagtctagtcacttcatcgtacacactgatgggaacacctacttgaattggtttcaccagaggccaggccaatctccaaggcgccttatttataaggtttctaaccgggactctggggtcccagacagattcagcggcagtgggtcaggcactgacttcacactggaaatcagcggggtggaggctgaggatgttggcgtttattactgcatgcagggtacagagtggcctcggacgttcggccaagggaccaaagtggatatcaaa

SEQ ID NO: 15121-15201 - skipped (81 entries)

SEQ ID NO: 15202 - protein, 126 aa, Artificial Sequence
  Description of Artificial Sequence: Synthetic polypeptide
QVQLVQSGAELKKPGSSVKVSCKASGGTFYNSAFSWLRHAPGQGPEWMGGITPSLGRVGYSERFLARLTITADESTSTVYMELTSLASEDTAVYYCARDASIVGTGNHLWYGLDFWGHGTTVTVSS

SEQ ID NO: 15203 - protein, 26 aa, Artificial Sequence
  Description of Artificial Sequence: Synthetic peptide
QVQLVQSGAELKKPGSSVKVSCKASG

SEQ ID NO: 15204 - protein, 9 aa, Artificial Sequence
  Description of Artificial Sequence: Synthetic peptide
GTFYNSAFS

SEQ ID NO: 15205 - protein, 14 aa, Artificial Sequence
  Description of Artificial Sequence: Synthetic peptide
WLRHAPGQGPEWMG

SEQ ID NO: 15206 - protein, 17 aa, Artificial Sequence
  Description of Artificial Sequence: Synthetic peptide
GITPSLGRVGYSERFLA

SEQ ID NO: 15207 - protein, 30 aa, Artificial Sequence
  Description of Artificial Sequence: Synthetic polypeptide
RLTITADESTSTVYMELTSLASEDTAVYYC

SEQ ID NO: 15208 - protein, 19 aa, Artificial Sequence
  Description of Artificial Sequence: Synthetic peptide
ARDASIVGTGNHLWYGLDF

SEQ ID NO: 15209 - protein, 11 aa, Artificial Sequence
  Description of Artificial Sequence: Synthetic peptide
WGHGTTVTVSS

SEQ ID NO: 15210 - DNA, 378 bp, Artificial Sequence
  Description of Artificial Sequence: Synthetic polynucleotide
caggtccagcttgtgcagtctggggctgaattgaagaagcctgggtcctcggtgaaggtctcctgcaaggcctctggaggcaccttctataattcagccttcagctggctgcgacacgccccgggacaagggcctgagtggatgggagggatcacccctagtttaggcagagtgggctactcagagaggttcctggccagactcacgattactgcggacgaatccacgagcacagtatacatggaattgaccagcctggcgtctgaggacacggccgtatattattgcgcgagagatgcgtctattgttggcactgggaatcacttgtggtacggtcttgatttctggggccacgggaccacggtcaccgtctcctca

SEQ ID NO: 15211 - skipped

SEQ ID NO: 15212 - protein, 112 aa, Artificial Sequence
  Description of Artificial Sequence: Synthetic polypeptide
ETTLTQSPLFLPVTLGQPASISCTSSVHVVHSDGNTYLNWFQQRPGQSPRRLIYKVSNRDSGVPDRFSGSGSGTYFTLKISRVEAEDVGVYYCMQGTDWPRTFGQGTKVDIK

SEQ ID NO: 15213 - protein, 23 aa, Artificial Sequence
  Description of Artificial Sequence: Synthetic peptide
ETTLTQSPLFLPVTLGQPASISC

SEQ ID NO: 15214 - protein, 16 aa, Artificial Sequence
  Description of Artificial Sequence: Synthetic peptide
TSSVHVVHSDGNTYLN

SEQ ID NO: 15215 - protein, 15 aa, Artificial Sequence
  Description of Artificial Sequence: Synthetic peptide
WFQQRPGQSPRRLIY

SEQ ID NO: 15216 - protein, 7 aa, Artificial Sequence
  Description of Artificial Sequence: Synthetic peptide
KVSNRDS

SEQ ID NO: 15217 - protein, 32 aa, Artificial Sequence
  Description of Artificial Sequence: Synthetic polypeptide
GVPDRFSGSGSGTYFTLKISRVEAEDVGVYYC

SEQ ID NO: 15218 - protein, 9 aa, Artificial Sequence
  Description of Artificial Sequence: Synthetic peptide
MQGTDWPRT

SEQ ID NO: 15219 - protein, 10 aa, Artificial Sequence
  Description of Artificial Sequence: Synthetic peptide
FGQGTKVDIK

SEQ ID NO: 15220 - DNA, 336 bp, Artificial Sequence
  Description of Artificial Sequence: Synthetic polynucleotide
gaaacgacactcacgcagtctccactcttcctgcccgtcacccttggacagccggcctccatctcctgcacgtccagtgtgcatgtcgtgcatagtgacggcaacacctatttgaattggtttcaacagaggccaggccaatctccaaggcgcctcatttataaggtttctaatcgggactctggggtcccagacagattcagcggcagtgggtcaggcacttatttcacactgaaaatcagcagggtggaggctgaagatgttggagtttattactgcatgcaaggtacagactggcctcggacgttcggccaagggaccaaagtggatatcaaa

SEQ ID NO: 15221-15301 - skipped (81 entries)

SEQ ID NO: 15302 - protein, 123 aa, Artificial Sequence
  Description of Artificial Sequence: Synthetic polypeptide
EVQLVESGGHVVLPGKSLRLSCAGSGFGFPLYAMQWVRRAPGKGLEWVALVSYDSSNIRYADSVKGRFTISRDNSQNTLYLQMDSLRPEDTAMYYCARDNALQDGRPGYFDSWGQGTLVTVSS

SEQ ID NO: 15303 - protein, 26 aa, Artificial Sequence
  Description of Artificial Sequence: Synthetic peptide
EVQLVESGGHVVLPGKSLRLSCAGSG

SEQ ID NO: 15304 - protein, 9 aa, Artificial Sequence
  Description of Artificial Sequence: Synthetic peptide
FGFPLYAMQ

SEQ ID NO: 15305 - protein, 14 aa, Artificial Sequence
  Description of Artificial Sequence: Synthetic peptide
WVRRAPGKGLEWVA

SEQ ID NO: 15306 - protein, 17 aa, Artificial Sequence
  Description of Artificial Sequence: Synthetic peptide
LVSYDSSNIRYADSVKG

SEQ ID NO: 15307 - protein, 30 aa, Artificial Sequence
  Description of Artificial Sequence: Synthetic polypeptide
RFTISRDNSQNTLYLQMDSLRPEDTAMYYC

SEQ ID NO: 15308 - protein, 16 aa, Artificial Sequence
  Description of Artificial Sequence: Synthetic peptide
ARDNALQDGRPGYFDS

SEQ ID NO: 15309 - protein, 11 aa, Artificial Sequence
  Description of Artificial Sequence: Synthetic peptide
WGQGTLVTVSS

SEQ ID NO: 15310 - DNA, 369 bp, Artificial Sequence
  Description of Artificial Sequence: Synthetic polynucleotide
gaggtgcagctggtggagtcggggggacacgtggtcctgcctgggaagtccctgagactctcctgtgcagggtctggtttcggtttccctctgtatgctatgcagtgggtccgccgggctccgggcaaggggctggagtgggtggcccttgtatcatatgatagcagcaacataagatatgcagactccgtgaagggccgattcaccatctccagagacaactcacagaacacactatatctccagatggacagcctgagacctgaagacacggctatgtattattgtgcgagggataacgcactgcaagacgggcggcccgggtactttgactcctggggccagggaaccctggtcaccgtctcctca

SEQ ID NO: 15311 - skipped

SEQ ID NO: 15312 - protein, 106 aa, Artificial Sequence
  Description of Artificial Sequence: Synthetic polypeptide
ETTLTQSPATLSLSPGERATLSCRASQSINDYLGWYQHRPGQAPRLLIHDASTRAPGIPVRFSGSGSGTDFTLTISSLEPEDSAVYYCQQRFSWYNFGPGTKVEIK

SEQ ID NO: 15313 - protein, 23 aa, Artificial Sequence
  Description of Artificial Sequence: Synthetic peptide
ETTLTQSPATLSLSPGERATLSC

SEQ ID NO: 15314 - protein, 11 aa, Artificial Sequence
  Description of Artificial Sequence: Synthetic peptide
RASQSINDYLG

SEQ ID NO: 15315 - protein, 15 aa, Artificial Sequence
  Description of Artificial Sequence: Synthetic peptide
WYQHRPGQAPRLLIH

SEQ ID NO: 15316 - protein, 7 aa, Artificial Sequence
  Description of Artificial Sequence: Synthetic peptide
DASTRAP

SEQ ID NO: 15317 - protein, 32 aa, Artificial Sequence
  Description of Artificial Sequence: Synthetic polypeptide
GIPVRFSGSGSGTDFTLTISSLEPEDSAVYYC

SEQ ID NO: 15318 - protein, 8 aa, Artificial Sequence
  Description of Artificial Sequence: Synthetic peptide
QQRFSWYN

SEQ ID NO: 15319 - protein, 10 aa, Artificial Sequence
  Description of Artificial Sequence: Synthetic peptide
FGPGTKVEIK

SEQ ID NO: 15320 - DNA, 318 bp, Artificial Sequence
  Description of Artificial Sequence: Synthetic polynucleotide
gaaacgacactcacgcagtctccagccaccctgtctttgtctccaggggaaagagcaaccctctcctgcagggccagtcagagtattaacgactacttaggctggtaccaacataggcctggccaggctcccaggctcctcattcatgatgcatccaccagggcccctggcatcccagtcaggttcagtggcagtgggtctgggacagacttcactctcaccatcagcagcctagagcctgaagattctgcagtttactactgtcagcagcgttttagctggtacaattttggcccggggaccaaggtggaaatcaaa

SEQ ID NO: 15321-15401 - skipped (81 entries)

SEQ ID NO: 15402 - protein, 123 aa, Artificial Sequence
  Description of Artificial Sequence: Synthetic polypeptide
EVQLVESGGGLVKPGGSLRLSCAASGFIFSDYYMSWIRQAPGKGLEWVSYITGSGRTIHYADSVKGRFTISRDNAKNSVYLQMNSLRAEDTAVYYCARGHRFLEFPLNYFDPWGQGTLVTVSS

SEQ ID NO: 15403 - protein, 26 aa, Artificial Sequence
  Description of Artificial Sequence: Synthetic peptide
EVQLVESGGGLVKPGGSLRLSCAASG

SEQ ID NO: 15404 - protein, 9 aa, Artificial Sequence
  Description of Artificial Sequence: Synthetic peptide
FIFSDYYMS

SEQ ID NO: 15405 - protein, 14 aa, Artificial Sequence
  Description of Artificial Sequence: Synthetic peptide
WIRQAPGKGLEWVS

SEQ ID NO: 15406 - protein, 17 aa, Artificial Sequence
  Description of Artificial Sequence: Synthetic peptide
YITGSGRTIHYADSVKG

SEQ ID NO: 15407 - protein, 30 aa, Artificial Sequence; identical to SEQ ID NO: 6407
  Description of Artificial Sequence: Synthetic polypeptide

SEQ ID NO: 15408 - protein, 16 aa, Artificial Sequence
  Description of Artificial Sequence: Synthetic peptide
ARGHRFLEFPLNYFDP

SEQ ID NO: 15409 - protein, 11 aa, Artificial Sequence
  Description of Artificial Sequence: Synthetic peptide
WGQGTLVTVSS

SEQ ID NO: 15410 - DNA, 369 bp, Artificial Sequence
  Description of Artificial Sequence: Synthetic polynucleotide
gaggtgcagctggtggagtcggggggaggcttggtcaagcctggagggtccctgagactctcctgtgcagcctctggattcatcttcagtgactactacatgagctggatccgccaggctccagggaaggggctggagtgggtttcgtacattactggtagtggtaggaccatacactacgcagactctgtgaagggccgattcaccatctccagggacaacgccaagaactcagtttatctgcagatgaacagcctgagagccgaggacacggccgtgtattactgtgcgaggggccatcgatttttggagttccccctaaactacttcgacccctggggccagggaaccctggtcaccgtctcctca

SEQ ID NO: 15411 - skipped

SEQ ID NO: 15412 - protein, 111 aa, Artificial Sequence
  Description of Artificial Sequence: Synthetic polypeptide
QSVLTQPASVSGSPGQSITISCAVTSSDVGSYNLVSWHQQHPGKAPKLMIYEVNKRPSGVSNRFSGSKSGNTASLTISGLQAEDEAVYYCCSYGGRSTSVVFGGGTKLTVL

SEQ ID NO: 15413 - protein, 22 aa, Artificial Sequence
  Description of Artificial Sequence: Synthetic peptide
QSVLTQPASVSGSPGQSITISC

SEQ ID NO: 15414 - protein, 14 aa, Artificial Sequence
  Description of Artificial Sequence: Synthetic peptide
AVTSSDVGSYNLVS

SEQ ID NO: 15415 - protein, 15 aa, Artificial Sequence
  Description of Artificial Sequence: Synthetic peptide
WHQQHPGKAPKLMIY

SEQ ID NO: 15416 - protein, 7 aa, Artificial Sequence
  Description of Artificial Sequence: Synthetic peptide
EVNKRPS

SEQ ID NO: 15417 - protein, 32 aa, Artificial Sequence
  Description of Artificial Sequence: Synthetic polypeptide
GVSNRFSGSKSGNTASLTISGLQAEDEAVYYC

SEQ ID NO: 15418 - protein, 11 aa, Artificial Sequence
  Description of Artificial Sequence: Synthetic peptide
CSYGGRSTSVV

SEQ ID NO: 15419 - protein, 10 aa, Artificial Sequence
  Description of Artificial Sequence: Synthetic peptide
FGGGTKLTVL

SEQ ID NO: 15420 - DNA, 333 bp, Artificial Sequence
  Description of Artificial Sequence: Synthetic polynucleotide
cagtctgtcctgactcagcctgcctccgtgtctgggtctcctggacagtcgatcaccatctcctgcgctgtcaccagcagtgatgttgggagttataaccttgtctcctggcaccagcagcacccaggcaaagcccccaaactcatgatttatgaggtcaataagcggccctcaggggtttctaatcgcttctctggctccaagtctggcaacacggcctccctgacaatctctgggctccaggctgaggacgaggctgtttattactgctgctcatatggaggtcgtagcacttctgtggtattcggcggagggaccaagctcaccgtccta

SEQ ID NO: 15421-15501 - skipped (81 entries)

SEQ ID NO: 15502 - protein, 123 aa, Artificial Sequence
  Description of Artificial Sequence: Synthetic polypeptide
EVQLLESGGHVVLPGKSLRLSCAGSGFGFPLYAMQWVRRAPGKGLEWVALVSYDSSNIRYADSVKGRFTISRDNSQNTLYLQMDSLRPEDTAMYYCARDNALQDGRPGYFDSWGQGTLVTVSS

SEQ ID NO: 15503 - protein, 26 aa, Artificial Sequence
  Description of Artificial Sequence: Synthetic peptide
EVQLLESGGHVVLPGKSLRLSCAGSG

SEQ ID NO: 15504 - protein, 9 aa, Artificial Sequence
  Description of Artificial Sequence: Synthetic peptide
FGFPLYAMQ

SEQ ID NO: 15505 - protein, 14 aa, Artificial Sequence
  Description of Artificial Sequence: Synthetic peptide
WVRRAPGKGLEWVA

SEQ ID NO: 15506 - protein, 17 aa, Artificial Sequence
  Description of Artificial Sequence: Synthetic peptide
LVSYDSSNIRYADSVKG

SEQ ID NO: 15507 - protein, 30 aa, Artificial Sequence; identical to SEQ ID NO: 15307
  Description of Artificial Sequence: Synthetic polypeptide

SEQ ID NO: 15508 - protein, 16 aa, Artificial Sequence
  Description of Artificial Sequence: Synthetic peptide
ARDNALQDGRPGYFDS

SEQ ID NO: 15509 - protein, 11 aa, Artificial Sequence
  Description of Artificial Sequence: Synthetic peptide
WGQGTLVTVSS

SEQ ID NO: 15510 - DNA, 369 bp, Artificial Sequence
  Description of Artificial Sequence: Synthetic polynucleotide
gaggtgcagctgttggagtcggggggacacgtggtcctgcctgggaagtccctgagactctcctgtgcagggtctggtttcggtttccctctgtatgctatgcagtgggtccgccgggctccgggcaaggggctggagtgggtggcccttgtatcatatgatagcagcaacataagatatgcagactccgtgaagggccgattcaccatctccagagacaactcacagaacacactatatctccagatggacagcctgagacctgaagacacggctatgtattattgtgcgagggataacgcactgcaagacgggcggcccgggtactttgactcctggggccagggaaccctggtcactgtctcctca

SEQ ID NO: 15511 - skipped

SEQ ID NO: 15512 - protein, 106 aa, Artificial Sequence
  Description of Artificial Sequence: Synthetic polypeptide
DIRLTQSPATLSLSPGERATLSCRASQSINDYLGWYQHRPGQAPRLLIHDASTRAPGIPVRFSGSGSGTDFTLTISSLEPEDSAVYYCQQRFSWYNFGPGTKLEIK

SEQ ID NO: 15513 - protein, 23 aa, Artificial Sequence
  Description of Artificial Sequence: Synthetic peptide
DIRLTQSPATLSLSPGERATLSC

SEQ ID NO: 15514 - protein, 11 aa, Artificial Sequence
  Description of Artificial Sequence: Synthetic peptide
RASQSINDYLG

SEQ ID NO: 15515 - protein, 15 aa, Artificial Sequence
  Description of Artificial Sequence: Synthetic peptide
WYQHRPGQAPRLLIH

SEQ ID NO: 15516 - protein, 7 aa, Artificial Sequence
  Description of Artificial Sequence: Synthetic peptide
DASTRAP

SEQ ID NO: 15517 - protein, 32 aa, Artificial Sequence; identical to SEQ ID NO: 15317
  Description of Artificial Sequence: Synthetic polypeptide

SEQ ID NO: 15518 - protein, 8 aa, Artificial Sequence
  Description of Artificial Sequence: Synthetic peptide
QQRFSWYN

SEQ ID NO: 15519 - protein, 10 aa, Artificial Sequence
  Description of Artificial Sequence: Synthetic peptide
FGPGTKLEIK

SEQ ID NO: 15520 - DNA, 318 bp, Artificial Sequence
  Description of Artificial Sequence: Synthetic polynucleotide
gacatccggttgacccagtctccagccaccctgtctttgtctccaggggaaagagcaaccctctcctgcagggccagtcagagtattaacgactacttaggctggtaccaacataggcctggccaggctcccaggctcctcattcatgatgcatccaccagggcccctggcatcccagtcaggttcagtggcagtgggtctgggacagacttcactctcaccatcagcagcctagagcctgaagattctgcagtttactactgtcagcagcgttttagctggtacaattttggcccggggaccaagctggagatcaaa

SEQ ID NO: 15521-15601 - skipped (81 entries)

SEQ ID NO: 15602 - protein, 130 aa, Artificial Sequence
  Description of Artificial Sequence: Synthetic polypeptide
EVQLVESGGGVVQPGRSLRLSCAASGFTFSKFAMHWVRQAPGKGLEWVAIISYDGSHKNYADSVKGRFTISRDNSKNTVYLQVDSLRAEDTAVYYCALLYGSGSYYNFVFFGWKDGSDAWGPGTTVTVSS

SEQ ID NO: 15603 - protein, 26 aa, Artificial Sequence
  Description of Artificial Sequence: Synthetic peptide
EVQLVESGGGVVQPGRSLRLSCAASG

SEQ ID NO: 15604 - protein, 9 aa, Artificial Sequence
  Description of Artificial Sequence: Synthetic peptide
FTFSKFAMH

SEQ ID NO: 15605 - protein, 14 aa, Artificial Sequence
  Description of Artificial Sequence: Synthetic peptide
WVRQAPGKGLEWVA

SEQ ID NO: 15606 - protein, 17 aa, Artificial Sequence
  Description of Artificial Sequence: Synthetic peptide
IISYDGSHKNYADSVKG

SEQ ID NO: 15607 - protein, 30 aa, Artificial Sequence
  Description of Artificial Sequence: Synthetic polypeptide
RFTISRDNSKNTVYLQVDSLRAEDTAVYYC

SEQ ID NO: 15608 - protein, 23 aa, Artificial Sequence
  Description of Artificial Sequence: Synthetic peptide
ALLYGSGSYYNFVFFGWKDGSDA

SEQ ID NO: 15609 - protein, 11 aa, Artificial Sequence
  Description of Artificial Sequence: Synthetic peptide
WGPGTTVTVSS

SEQ ID NO: 15610 - DNA, 390 bp, Artificial Sequence
  Description of Artificial Sequence: Synthetic polynucleotide
gaggtgcagctggtggagtctgggggaggcgtggtccagcccgggaggtccctgagactctcctgtgcagcctctggattcaccttcagtaaatttgctatgcactgggtccgccaggctccaggcaaggggctggagtgggtggcgattatatcctatgatggaagtcataaaaactacgcagactccgtgaagggccgattcaccatctccagagacaattccaagaacacagtgtatctgcaagtggacagtctgagagctgaagacacggctgtctattactgtgcacttctctatggttcgggaagttattacaattttgtttttttcggctggaaggatgggtctgacgcctggggcccagggaccacggtcaccgtctcctca

SEQ ID NO: 15611 - skipped

SEQ ID NO: 15612 - protein, 110 aa, Artificial Sequence
  Description of Artificial Sequence: Synthetic polypeptide
QPVLTQPASVSGSPGQSITISCTGTTSDVGGYDYVSWYQQRPGKAPKLIIYDVINRPSGVSNRFSGSKSGNTASLTISGLQADDETDYYCSSYTSGGTLVFGTGTKLTVL

SEQ ID NO: 15613 - protein, 22 aa, Artificial Sequence
  Description of Artificial Sequence: Synthetic peptide
QPVLTQPASVSGSPGQSITISC

SEQ ID NO: 15614 - protein, 14 aa, Artificial Sequence
  Description of Artificial Sequence: Synthetic peptide
TGTTSDVGGYDYVS

SEQ ID NO: 15615 - protein, 15 aa, Artificial Sequence
  Description of Artificial Sequence: Synthetic peptide
WYQQRPGKAPKLIIY

SEQ ID NO: 15616 - protein, 7 aa, Artificial Sequence
  Description of Artificial Sequence: Synthetic peptide
DVINRPS

SEQ ID NO: 15617 - protein, 32 aa, Artificial Sequence
  Description of Artificial Sequence: Synthetic polypeptide
GVSNRFSGSKSGNTASLTISGLQADDETDYYC

SEQ ID NO: 15618 - protein, 10 aa, Artificial Sequence
  Description of Artificial Sequence: Synthetic peptide
SSYTSGGTLV

SEQ ID NO: 15619 - protein, 10 aa, Artificial Sequence
  Description of Artificial Sequence: Synthetic peptide
FGTGTKLTVL

SEQ ID NO: 15620 - DNA, 330 bp, Artificial Sequence
  Description of Artificial Sequence: Synthetic polynucleotide
cagcctgtgctgactcagcccgcctccgtgtctgggtctcctggacagtcgatcaccatctcctgcactggaaccactagtgacgttggtggttatgactatgtctcctggtaccagcaacgcccaggcaaagcccccaaactcatcatttatgatgtcattaatcggccctcaggggtttccaatcgcttctctggctccaagtctggcaacacggcctccctgaccatctctggcctccaggctgacgacgaaactgattattactgcagctcatatacaagcggcggcactcttgtcttcggaactgggaccaagctcaccgtccta

SEQ ID NO: 15621-15701 - skipped (81 entries)

SEQ ID NO: 15702 - protein, 129 aa, Artificial Sequence
  Description of Artificial Sequence: Synthetic polypeptide
QVQLVQSGAEVKKPGSSVKVSCKASGGMFTDYAISWVRQAPGQRLEWMGGILPAFAASGSPGYAPIFRGRATFSADVSTSTAYLELTNLKPEDTAVYYCARDPSILNTGNHHWYDLDLWGQGTEVTVSS

SEQ ID NO: 15703 - protein, 26 aa, Artificial Sequence
  Description of Artificial Sequence: Synthetic peptide
QVQLVQSGAEVKKPGSSVKVSCKASG

SEQ ID NO: 15704 - protein, 9 aa, Artificial Sequence
  Description of Artificial Sequence: Synthetic peptide
GMFTDYAIS

SEQ ID NO: 15705 - protein, 14 aa, Artificial Sequence
  Description of Artificial Sequence: Synthetic peptide
WVRQAPGQRLEWMG

SEQ ID NO: 15706 - protein, 20 aa, Artificial Sequence
  Description of Artificial Sequence: Synthetic peptide
GILPAFAASGSPGYAPIFRG

SEQ ID NO: 15707 - protein, 30 aa, Artificial Sequence
  Description of Artificial Sequence: Synthetic polypeptide
RATFSADVSTSTAYLELTNLKPEDTAVYYC

SEQ ID NO: 15708 - protein, 19 aa, Artificial Sequence
  Description of Artificial Sequence: Synthetic peptide
ARDPSILNTGNHHWYDLDL

SEQ ID NO: 15709 - protein, 11 aa, Artificial Sequence
  Description of Artificial Sequence: Synthetic peptide
WGQGTEVTVSS

SEQ ID NO: 15710 - DNA, 387 bp, Artificial Sequence
  Description of Artificial Sequence: Synthetic polynucleotide
caggtccagcttgtacagtctggggcagaggtgaagaagcctgggtcctcggtgaaggtctcctgcaaggcttctggaggcatgttcactgactatgccatcagttgggtgcgacaggcccctggacaacgacttgagtggatgggagggatcttgcctgcctttgcagcctctggttcgccaggctacgcaccgattttccggggcagagccaccttttccgcggacgtatccacgagcacggcctacttggaactgaccaacctgaagcctgaggacacggccgtgtattattgtgcgagagacccgtctattcttaacactgggaatcatcactggtatgatttagatctctggggccaagggacagaggtcaccgtctcctca

SEQ ID NO: 15711 - skipped

SEQ ID NO: 15712 - protein, 112 aa, Artificial Sequence
  Description of Artificial Sequence: Synthetic polypeptide
DIQMTQSPLSLPVGLGQSASISCRSSQWVVHTDGNTYLNWFHQRPGQSPRRLIYKVSNRDSGVPDRFSGSGSGTDFTLRISRVEAEDVGVYYCMQATEWPRTFGQGTKVEIK

SEQ ID NO: 15713 - protein, 23 aa, Artificial Sequence
  Description of Artificial Sequence: Synthetic peptide
DIQMTQSPLSLPVGLGQSASISC

SEQ ID NO: 15714 - protein, 16 aa, Artificial Sequence
  Description of Artificial Sequence: Synthetic peptide
RSSQWVVHTDGNTYLN

SEQ ID NO: 15715 - protein, 15 aa, Artificial Sequence
  Description of Artificial Sequence: Synthetic peptide
WFHQRPGQSPRRLIY

SEQ ID NO: 15716 - protein, 7 aa, Artificial Sequence
  Description of Artificial Sequence: Synthetic peptide
KVSNRDS

SEQ ID NO: 15717 - protein, 32 aa, Artificial Sequence; identical to SEQ ID NO: 3517
  Description of Artificial Sequence: Synthetic polypeptide

SEQ ID NO: 15718 - protein, 9 aa, Artificial Sequence
  Description of Artificial Sequence: Synthetic peptide
MQATEWPRT

SEQ ID NO: 15719 - protein, 10 aa, Artificial Sequence
  Description of Artificial Sequence: Synthetic peptide
FGQGTKVEIK

SEQ ID NO: 15720 - DNA, 336 bp, Artificial Sequence
  Description of Artificial Sequence: Synthetic polynucleotide
gacatccagatgacccagtctccactctccctgcccgtcggcctcggacagtcggcctccatctcctgcaggtctagtcaatgggtcgtgcacactgatgggaacacctacttgaattggtttcaccagaggccaggccaatctccaaggcgcctcatttataaggtttctaaccgggactccggggtcccagacagatttagcggcagtgggtcaggcactgatttcaccctgagaatcagcagggtggaggctgaggatgttggcgtttattactgcatgcaagctacagagtggcctcggacgttcggccaagggaccaaggtggaaatcaaa

SEQ ID NO: 15721-15801 - skipped (81 entries)

SEQ ID NO: 15802 - protein, 126 aa, Artificial Sequence; identical to SEQ ID NO: 1702
  Description of Artificial Sequence: Synthetic polypeptide

SEQ ID NO: 15803 - protein, 26 aa, Artificial Sequence
  Description of Artificial Sequence: Synthetic peptide
QVQLVQSGAELKKPGSSVRVSCKAAG

SEQ ID NO: 15804 - protein, 9 aa, Artificial Sequence
  Description of Artificial Sequence: Synthetic peptide
GTLTNYAIS

SEQ ID NO: 15805 - protein, 14 aa, Artificial Sequence
  Description of Artificial Sequence: Synthetic peptide
WVRQAPGQGFEWMG

SEQ ID NO: 15806 - protein, 17 aa, Artificial Sequence
  Description of Artificial Sequence: Synthetic peptide
GIMPVSHTAGYAQKFQG

SEQ ID NO: 15807 - protein, 30 aa, Artificial Sequence; identical to SEQ ID NO: 1507
  Description of Artificial Sequence: Synthetic polypeptide

SEQ ID NO: 15808 - protein, 19 aa, Artificial Sequence
  Description of Artificial Sequence: Synthetic peptide
ARDPSIHYTGNHHWYDLDI

SEQ ID NO: 15809 - protein, 11 aa, Artificial Sequence
  Description of Artificial Sequence: Synthetic peptide
WGQGTMVTVSS

SEQ ID NO: 15810 - DNA, 378 bp, Artificial Sequence
  Description of Artificial Sequence: Synthetic polynucleotide
caggtccagcttgtacagtctggggctgagttgaagaagcctgggtcgtcggtgagggtctcctgcaaggcggctggaggcaccctcactaattatgccataagttgggtgcgacaggcccctggacaagggtttgagtggatgggagggatcatgcctgtctctcatacggcaggctacgcacagaaatttcagggccgagtcacctttaccgcggacgaatccgcgaccacagcctacatggacctaacgagcctgagacctgaggacacggccatatattactgtgccagagatccgtctattcattacactgggaatcaccattggtatgatttagatatctggggccaagggacaatggtcaccgtctcctca

SEQ ID NO: 15811 - skipped

SEQ ID NO: 15812 - protein, 112 aa, Artificial Sequence
  Description of Artificial Sequence: Synthetic polypeptide
DIQLTQSPLSLPVTLGQPASISCRSSQRIVHTDGNTYLNWFLQRPGQSPRRLIYKVSNRDSGVPDRFSGSGSGTDFTLKISRVEAEDVGIYYCMQGTEWPRTFGQGTKVEIK

SEQ ID NO: 15813 - protein, 23 aa, Artificial Sequence
  Description of Artificial Sequence: Synthetic peptide
DIQLTQSPLSLPVTLGQPASISC

SEQ ID NO: 15814 - protein, 16 aa, Artificial Sequence
  Description of Artificial Sequence: Synthetic peptide
RSSQRIVHTDGNTYLN

SEQ ID NO: 15815 - protein, 15 aa, Artificial Sequence
  Description of Artificial Sequence: Synthetic peptide
WFLQRPGQSPRRLIY

SEQ ID NO: 15816 - protein, 7 aa, Artificial Sequence
  Description of Artificial Sequence: Synthetic peptide
KVSNRDS

SEQ ID NO: 15817 - protein, 32 aa, Artificial Sequence; identical to SEQ ID NO: 1517
  Description of Artificial Sequence: Synthetic polypeptide

SEQ ID NO: 15818 - protein, 9 aa, Artificial Sequence
  Description of Artificial Sequence: Synthetic peptide
MQGTEWPRT

SEQ ID NO: 15819 - protein, 10 aa, Artificial Sequence
  Description of Artificial Sequence: Synthetic peptide
FGQGTKVEIK

SEQ ID NO: 15820 - DNA, 336 bp, Artificial Sequence
  Description of Artificial Sequence: Synthetic polynucleotide
gacatccagttgacccagtctccactctccctgcccgtcacccttggccagccggcctccatctcctgcaggtctagtcaaagaatcgtccacactgatggaaacacctacttgaattggtttctgcagaggccaggccaatctccaaggcgcctaatttataaggtctctaaccgggactccggggtcccagacagattcagcggcagtgggtcaggcactgatttcacactgaaaatcagcagggtggaggctgaggatgttggaatttattactgcatgcaaggtacagagtggcctcggacgttcggccaagggaccaaggtggaaatcaaa

SEQ ID NO: 15821-15901 - skipped (81 entries)

SEQ ID NO: 15902 - protein, 129 aa, Artificial Sequence
  Description of Artificial Sequence: Synthetic polypeptide
QVQLVQSGAEVKKPGSSMRVSCRVSGGTFITHAMSWVRQAPGQGPEWMGGIVPLFGRASYAQPSQTRVQITADESTSTVYLEVPSLTSEDTAVYYCVRDSEPYTATRSQNHYWYDMDVWGQGTTVTVSS

SEQ ID NO: 15903 - protein, 26 aa, Artificial Sequence
  Description of Artificial Sequence: Synthetic peptide
QVQLVQSGAEVKKPGSSMRVSCRVSG

SEQ ID NO: 15904 - protein, 9 aa, Artificial Sequence
  Description of Artificial Sequence: Synthetic peptide
GTFITHAMS

SEQ ID NO: 15905 - protein, 14 aa, Artificial Sequence
  Description of Artificial Sequence: Synthetic peptide
WVRQAPGQGPEWMG

SEQ ID NO: 15906 - protein, 17 aa, Artificial Sequence
  Description of Artificial Sequence: Synthetic peptide
GIVPLFGRASYAQPSQT

SEQ ID NO: 15907 - protein, 30 aa, Artificial Sequence; identical to SEQ ID NO: 8907
  Description of Artificial Sequence: Synthetic polypeptide

SEQ ID NO: 15908 - protein, 22 aa, Artificial Sequence
  Description of Artificial Sequence: Synthetic peptide
VRDSEPYTATRSQNHYWYDMDV

SEQ ID NO: 15909 - protein, 11 aa, Artificial Sequence
  Description of Artificial Sequence: Synthetic peptide
WGQGTTVTVSS

SEQ ID NO: 15910 - DNA, 387 bp, Artificial Sequence
  Description of Artificial Sequence: Synthetic polynucleotide
caggtccagctggtacagtctggggctgaagtgaagaagcctgggtcctcgatgagggtctcctgtagggtttctggaggcaccttcatcacccatgctatgagttgggtgcgacaggcccctggacaagggccggagtggatgggagggatcgtccctctttttgggagagcgagctacgcacagccgtcgcagaccagagtccaaattactgcggacgaaagtacgagtacagtgtatctggaagtgcccagcctgacatctgaggacacggccgtctattactgtgtgagagattctgagccctacacggcgacgaggagtcaaaatcattattggtatgatatggacgtctggggccaagggaccacggtcaccgtctcctca

SEQ ID NO: 15911 - skipped

SEQ ID NO: 15912 - protein, 113 aa, Artificial Sequence
  Description of Artificial Sequence: Synthetic polypeptide
ETTLTQSPLSLSVTLGQSASISCRASQTVVHSVDGNTYLNWFHQRPGQSPRRLIYKVSNRDSGVPDRFSGSGSGTDFTLRISRVEAEDIGIYYCMQGTDWPRTFGQGTKVEIK

SEQ ID NO: 15913 - protein, 23 aa, Artificial Sequence
  Description of Artificial Sequence: Synthetic peptide
ETTLTQSPLSLSVTLGQSASISC

SEQ ID NO: 15914 - protein, 17 aa, Artificial Sequence
  Description of Artificial Sequence: Synthetic peptide
RASQTVVHSVDGNTYLN

SEQ ID NO: 15915 - protein, 15 aa, Artificial Sequence
  Description of Artificial Sequence: Synthetic peptide
WFHQRPGQSPRRLIY

SEQ ID NO: 15916 - protein, 7 aa, Artificial Sequence
  Description of Artificial Sequence: Synthetic peptide
KVSNRDS

SEQ ID NO: 15917 - protein, 32 aa, Artificial Sequence; identical to SEQ ID NO: 8917
  Description of Artificial Sequence: Synthetic polypeptide

SEQ ID NO: 15918 - protein, 9 aa, Artificial Sequence
  Description of Artificial Sequence: Synthetic peptide
MQGTDWPRT

SEQ ID NO: 15919 - protein, 10 aa, Artificial Sequence
  Description of Artificial Sequence: Synthetic peptide
FGQGTKVEIK

SEQ ID NO: 15920 - DNA, 339 bp, Artificial Sequence
  Description of Artificial Sequence: Synthetic polynucleotide
gaaacgacactcacgcagtctccactctccctgtccgtcacccttggacagtcggcctccatctcctgcagggctagtcaaaccgtcgtacacagtgttgatggaaacacgtacttgaattggtttcaccagaggccaggccaatctccaaggcgcctaatttataaggtttctaatcgggactctggggtcccagacagattcagcggcagtgggtcaggcactgacttcacactgaggatcagcagagtggaggctgaagatattgggatttattattgcatgcaaggtacagactggcctcggacctttggccaggggaccaaggtggaaatcaaa

SEQ ID NO: 15921-16001 - skipped (81 entries)

SEQ ID NO: 16002 - protein, 126 aa, Artificial Sequence; identical to SEQ ID NO: 1502
  Description of Artificial Sequence: Synthetic polypeptide

SEQ ID NO: 16003 - protein, 26 aa, Artificial Sequence
  Description of Artificial Sequence: Synthetic peptide
QVQLVQSGAELKKPGSSVRVSCKAAG

SEQ ID NO: 16004 - protein, 9 aa, Artificial Sequence
  Description of Artificial Sequence: Synthetic peptide
GTLTNYAIS

SEQ ID NO: 16005 - protein, 14 aa, Artificial Sequence
  Description of Artificial Sequence: Synthetic peptide
WVRQAPGQGFEWMG

SEQ ID NO: 16006 - protein, 17 aa, Artificial Sequence
  Description of Artificial Sequence: Synthetic peptide
GIMPVSHTAGYAQKFQG

SEQ ID NO: 16007 - protein, 30 aa, Artificial Sequence; identical to SEQ ID NO: 1507
  Description of Artificial Sequence: Synthetic polypeptide

SEQ ID NO: 16008 - protein, 19 aa, Artificial Sequence
  Description of Artificial Sequence: Synthetic peptide
ARDPSIHYTGNHHWYDLDI

SEQ ID NO: 16009 - protein, 11 aa, Artificial Sequence
  Description of Artificial Sequence: Synthetic peptide
WGQGTTVTVSS

SEQ ID NO: 16010 - DNA, 378 bp, Artificial Sequence
  Description of Artificial Sequence: Synthetic polynucleotide
caggtccagctggtgcagtctggggctgagttgaagaagcctgggtcgtcggtgagggtctcctgcaaggcggctggaggcaccctcactaattatgccataagttgggtgcgacaggcccctggacaagggtttgagtggatgggagggatcatgcctgtctctcatacggcaggctacgcacagaaatttcagggccgagtcacctttaccgcggacgaatccgcgaccacagcctacatggacctaacgagcctgagacctgaggacacggccatatattactgtgccagagatccgtctattcattacactgggaatcaccattggtatgatttagatatctggggccaagggaccacggtcaccgtctcctca

SEQ ID NO: 16011 - skipped

SEQ ID NO: 16012 - protein, 112 aa, Artificial Sequence
  Description of Artificial Sequence: Synthetic polypeptide
DIVMTQSPLSLPVTLGQPASISCRSSQRIVHTDGNTYLNWFLQRPGQSPRRLIYKVSNRDSGVPDRFSGSGSGTDFTLKISRVEAEDVGIYYCMQGTEWPRTFGQGTKVEIK

SEQ ID NO: 16013 - protein, 23 aa, Artificial Sequence
  Description of Artificial Sequence: Synthetic peptide
DIVMTQSPLSLPVTLGQPASISC

SEQ ID NO: 16014 - protein, 16 aa, Artificial Sequence
  Description of Artificial Sequence: Synthetic peptide
RSSQRIVHTDGNTYLN

SEQ ID NO: 16015 - protein, 15 aa, Artificial Sequence
  Description of Artificial Sequence: Synthetic peptide
WFLQRPGQSPRRLIY

SEQ ID NO: 16016 - protein, 7 aa, Artificial Sequence
  Description of Artificial Sequence: Synthetic peptide
KVSNRDS

SEQ ID NO: 16017 - protein, 32 aa, Artificial Sequence; identical to SEQ ID NO: 1517
  Description of Artificial Sequence: Synthetic polypeptide

SEQ ID NO: 16018 - protein, 9 aa, Artificial Sequence
  Description of Artificial Sequence: Synthetic peptide
MQGTEWPRT

SEQ ID NO: 16019 - protein, 10 aa, Artificial Sequence
  Description of Artificial Sequence: Synthetic peptide
FGQGTKVEIK

SEQ ID NO: 16020 - DNA, 336 bp, Artificial Sequence
  Description of Artificial Sequence: Synthetic polynucleotide
gatattgtgatgacccagtctccactctccctgcccgtcacccttggccagccggcctccatctcctgcaggtctagtcaaagaatcgtccacactgatggaaacacctacttgaattggtttctgcagaggccaggccaatctccaaggcgcctaatttataaggtctctaaccgggactccggggtcccagacagattcagcggcagtgggtcaggcactgatttcacactgaaaatcagcagggtggaggctgaggatgttggaatttattactgcatgcaaggtacagagtggcctcggacgttcggccaagggaccaaggtggaaatcaaa

SEQ ID NO: 16021-16101 - skipped (81 entries)

SEQ ID NO: 16102 - protein, 126 aa, Artificial Sequence
  Description of Artificial Sequence: Synthetic polypeptide
QVQLVQSGAEVKKPGSSVKVSCKASGGTLSHYAISWVRQAPGQGLEWMGGIMPVSGTVGYAQKFQGRVKFTADEYASTAYMELTNLRSEDSAVYFCARDPSIVDSGPHHWYDLDIWGQGTMVTVSS

SEQ ID NO: 16103 - protein, 26 aa, Artificial Sequence
  Description of Artificial Sequence: Synthetic peptide
QVQLVQSGAEVKKPGSSVKVSCKASG

SEQ ID NO: 16104 - protein, 9 aa, Artificial Sequence
  Description of Artificial Sequence: Synthetic peptide
GTLSHYAIS

SEQ ID NO: 16105 - protein, 14 aa, Artificial Sequence
  Description of Artificial Sequence: Synthetic peptide
WVRQAPGQGLEWMG

SEQ ID NO: 16106 - protein, 17 aa, Artificial Sequence
  Description of Artificial Sequence: Synthetic peptide
GIMPVSGTVGYAQKFQG

SEQ ID NO: 16107 - protein, 30 aa, Artificial Sequence
  Description of Artificial Sequence: Synthetic polypeptide
RVKFTADEYASTAYMELTNLRSEDSAVYFC

SEQ ID NO: 16108 - protein, 19 aa, Artificial Sequence
  Description of Artificial Sequence: Synthetic peptide
ARDPSIVDSGPHHWYDLDI

SEQ ID NO: 16109 - protein, 11 aa, Artificial Sequence
  Description of Artificial Sequence: Synthetic peptide
WGQGTMVTVSS

SEQ ID NO: 16110 - DNA, 378 bp, Artificial Sequence
  Description of Artificial Sequence: Synthetic polynucleotide
caggtccagcttgtgcagtctggggctgaggtgaagaagcctgggtcctcggtgaaggtctcctgcaaggcttctggaggcaccctcagtcactatgccatcagctgggtgcgacaggcccctggacaaggccttgagtggatgggagggatcatgcctgtctctggaacggtaggctacgctcagaagttccagggcagagtcaagttcaccgcggacgaatacgcgagcacagcctacatggaattgacgaacctcagatctgaggactcggccgtatatttctgtgcgagagatccgtctattgttgatagtgggcctcaccactggtatgatttggatatttggggccaagggacaatggtcaccgtctcctcc

SEQ ID NO: 16111 - skipped

SEQ ID NO: 16112 - protein, 112 aa, Artificial Sequence
  Description of Artificial Sequence: Synthetic polypeptide
DIRMTQSPLSLPVTLGQPASISCRSSQFVVHTDGNTYLNWFQQRPGQSPRRLIYKVSNRDSGVPDRFSGSGSGTDFTLKISRVEAEDVGVYYCMQATEWPRTFGQGTKVDIK

SEQ ID NO: 16113 - protein, 23 aa, Artificial Sequence
  Description of Artificial Sequence: Synthetic peptide
DIRMTQSPLSLPVTLGQPASISC

SEQ ID NO: 16114 - protein, 16 aa, Artificial Sequence
  Description of Artificial Sequence: Synthetic peptide
RSSQFVVHTDGNTYLN

SEQ ID NO: 16115 - protein, 15 aa, Artificial Sequence
  Description of Artificial Sequence: Synthetic peptide
WFQQRPGQSPRRLIY

SEQ ID NO: 16116 - protein, 7 aa, Artificial Sequence
  Description of Artificial Sequence: Synthetic peptide
KVSNRDS

SEQ ID NO: 16117 - protein, 32 aa, Artificial Sequence; identical to SEQ ID NO: 917
  Description of Artificial Sequence: Synthetic polypeptide

SEQ ID NO: 16118 - protein, 9 aa, Artificial Sequence
  Description of Artificial Sequence: Synthetic peptide
MQATEWPRT

SEQ ID NO: 16119 - protein, 10 aa, Artificial Sequence
  Description of Artificial Sequence: Synthetic peptide
FGQGTKVDIK

SEQ ID NO: 16120 - DNA, 336 bp, Artificial Sequence
  Description of Artificial Sequence: Synthetic polynucleotide
gacatccggatgacccagtctccactctccctgcccgtcacccttggacagccggcctccatctcctgcaggtctagtcaattcgtcgtacatactgatggaaacacctacttaaattggtttcagcagaggccaggccaatctccaaggcgtctaatttataaggtttctaaccgggactccggggtcccagacagattcagcggcagtgggtcaggcactgatttcacactgaaaatcagcagggtggaggctgaggatgttggggtttattactgcatgcaagcaacagagtggcctcggacgttcggccaagggaccaaagtggatatcaaa

SEQ ID NO: 16121-16201 - skipped (81 entries)

SEQ ID NO: 16202 - protein, 116 aa, Artificial Sequence
  Description of Artificial Sequence: Synthetic polypeptide
QVQLVESGAEVKRPGASVKVSCKASGYAFSDYYMHWVRQAPGQGPEWMGWINPNSGDTGYPQKFRGWVTMTRDTSVSTAYMELKRLKSDDTAVYYCASGPNYFDYWGQGTLVTVSS

SEQ ID NO: 16203 - protein, 26 aa, Artificial Sequence
  Description of Artificial Sequence: Synthetic peptide
QVQLVESGAEVKRPGASVKVSCKASG

SEQ ID NO: 16204 - protein, 9 aa, Artificial Sequence
  Description of Artificial Sequence: Synthetic peptide
YAFSDYYMH

SEQ ID NO: 16205 - protein, 14 aa, Artificial Sequence
  Description of Artificial Sequence: Synthetic peptide
WVRQAPGQGPEWMG

SEQ ID NO: 16206 - protein, 17 aa, Artificial Sequence
  Description of Artificial Sequence: Synthetic peptide
WINPNSGDTGYPQKFRG

SEQ ID NO: 16207 - protein, 30 aa, Artificial Sequence
  Description of Artificial Sequence: Synthetic polypeptide
WVTMTRDTSVSTAYMELKRLKSDDTAVYYC

SEQ ID NO: 16208 - protein, 9 aa, Artificial Sequence
  Description of Artificial Sequence: Synthetic peptide
ASGPNYFDY

SEQ ID NO: 16209 - protein, 11 aa, Artificial Sequence
  Description of Artificial Sequence: Synthetic peptide
WGQGTLVTVSS

SEQ ID NO: 16210 - DNA, 348 bp, Artificial Sequence
  Description of Artificial Sequence: Synthetic polynucleotide
caggtgcagctggtggagtctggggctgaggtgaagaggcctggggcctcagtgaaggtctcctgcaaggcttctggatacgccttcagcgactactatatgcactgggtgcgacaggcccctgggcaagggcctgagtggatgggatggatcaaccctaacagtggtgacactggctatccacaaaaatttcggggctgggtcaccatgacccgagacacgtccgtcagcacagcctacatggagctgaagagactgaaatctgacgacacggccgtttattactgtgcgagcggtcccaactactttgactactggggccagggaaccctggtcaccgtctcctca

SEQ ID NO: 16211 - skipped

SEQ ID NO: 16212 - protein, 108 aa, Artificial Sequence
  Description of Artificial Sequence: Synthetic polypeptide
SYVLTQPPSVSVSPGQTARITCSADGLPKQYSYWYQQKPGQAPVMVIYKDTERPSGIPERFSGSSSGTTATLTISGVQAEDEADYYCQSADSNDSSPVFGGGTQLTVL

SEQ ID NO: 16213 - protein, 22 aa, Artificial Sequence
  Description of Artificial Sequence: Synthetic peptide
SYVLTQPPSVSVSPGQTARITC

SEQ ID NO: 16214 - protein, 11 aa, Artificial Sequence
  Description of Artificial Sequence: Synthetic peptide
SADGLPKQYSY

SEQ ID NO: 16215 - protein, 15 aa, Artificial Sequence
  Description of Artificial Sequence: Synthetic peptide
WYQQKPGQAPVMVIY

SEQ ID NO: 16216 - protein, 7 aa, Artificial Sequence
  Description of Artificial Sequence: Synthetic peptide
KDTERPS

SEQ ID NO: 16217 - protein, 32 aa, Artificial Sequence
  Description of Artificial Sequence: Synthetic polypeptide
GIPERFSGSSSGTTATLTISGVQAEDEADYYC

SEQ ID NO: 16218 - protein, 11 aa, Artificial Sequence
  Description of Artificial Sequence: Synthetic peptide
QSADSNDSSPV

SEQ ID NO: 16219 - protein, 10 aa, Artificial Sequence
  Description of Artificial Sequence: Synthetic peptide
FGGGTQLTVL

SEQ ID NO: 16220 - DNA, 324 bp, Artificial Sequence
  Description of Artificial Sequence: Synthetic polynucleotide
tcctatgtgctgacacagccaccctcggtgtcggtttccccaggacagacggccaggatcacctgctctgcagatggattgccaaaacaatattcttattggtaccaacagaagccaggccaggcccctgtcatggtgatatataaagacactgagaggccctcagggatccctgagcgattctctggctccagctcagggacaacagccacgttgaccatcagtggagtccaggcagaagacgaggctgactattactgtcaatcagcagacagcaatgattcttctcctgtgttcggaggaggcacccagctgaccgtccta

SEQ ID NO: 16221-16301 - skipped (81 entries)

SEQ ID NO: 16302 - protein, 125 aa, Artificial Sequence
  Description of Artificial Sequence: Synthetic polypeptide
EVQLLESGGGLVKPGGSLRLSCEASGFTFSNYNMNWVRQAPGKGLEWVSSISGSSSYISYADSVKGRFTISRDNAKNSLYLQMNSLRVEDTAVYYCARADRDYDFWSDPPLIDHWGQGTLVTVSS

SEQ ID NO: 16303 - protein, 26 aa, Artificial Sequence
  Description of Artificial Sequence: Synthetic peptide
EVQLLESGGGLVKPGGSLRLSCEASG

SEQ ID NO: 16304 - protein, 9 aa, Artificial Sequence
  Description of Artificial Sequence: Synthetic peptide
FTFSNYNMN

SEQ ID NO: 16305 - protein, 14 aa, Artificial Sequence
  Description of Artificial Sequence: Synthetic peptide
WVRQAPGKGLEWVS

SEQ ID NO: 16306 - protein, 17 aa, Artificial Sequence
  Description of Artificial Sequence: Synthetic peptide
SISGSSSYISYADSVKG

SEQ ID NO: 16307 - protein, 30 aa, Artificial Sequence
  Description of Artificial Sequence: Synthetic polypeptide
RFTISRDNAKNSLYLQMNSLRVEDTAVYYC

SEQ ID NO: 16308 - protein, 18 aa, Artificial Sequence
  Description of Artificial Sequence: Synthetic peptide
ARADRDYDFWSDPPLIDH

SEQ ID NO: 16309 - protein, 11 aa, Artificial Sequence
  Description of Artificial Sequence: Synthetic peptide
WGQGTLVTVSS

SEQ ID NO: 16310 - DNA, 375 bp, Artificial Sequence
  Description of Artificial Sequence: Synthetic polynucleotide
gaggtgcagctgttggagtctgggggaggcctggtcaagcctggggggtccctgagactctcctgtgaagcctctggattcaccttcagtaactataacatgaactgggtccgccaggctccagggaaggggctggagtgggtctcatccatcagcggtagtagtagttacatatcctatgcagactcagtgaagggccgattcaccatctccagagacaacgccaagaattcactgtatctgcaaatgaacagcctgagagtcgaggacacggctgtctattactgtgcgagagcggatcgggattacgatttttggagtgatccccccctgattgaccactggggccagggaaccctggtcaccgtctcctca

SEQ ID NO: 16311 - skipped

SEQ ID NO: 16312 - protein, 107 aa, Artificial Sequence
  Description of Artificial Sequence: Synthetic polypeptide
ETTLTQSPATLSLSPGEGATLSCRASQSVSSSLAWYQQKPGQAPRLLIYDASNRATGIPARFSGSGSGTDYTLTISSLEPEDFAVYYCHQRSNWPYTFGQGTKVEIK

SEQ ID NO: 16313 - protein, 23 aa, Artificial Sequence
  Description of Artificial Sequence: Synthetic peptide
ETTLTQSPATLSLSPGEGATLSC

SEQ ID NO: 16314 - protein, 11 aa, Artificial Sequence
  Description of Artificial Sequence: Synthetic peptide
RASQSVSSSLA

SEQ ID NO: 16315 - protein, 15 aa, Artificial Sequence
  Description of Artificial Sequence: Synthetic peptide
WYQQKPGQAPRLLIY

SEQ ID NO: 16316 - protein, 7 aa, Artificial Sequence
  Description of Artificial Sequence: Synthetic peptide
DASNRAT

SEQ ID NO: 16317 - protein, 32 aa, Artificial Sequence
  Description of Artificial Sequence: Synthetic polypeptide
GIPARFSGSGSGTDYTLTISSLEPEDFAVYYC

SEQ ID NO: 16318 - protein, 9 aa, Artificial Sequence
  Description of Artificial Sequence: Synthetic peptide
HQRSNWPYT

SEQ ID NO: 16319 - protein, 10 aa, Artificial Sequence
  Description of Artificial Sequence: Synthetic peptide
FGQGTKVEIK

SEQ ID NO: 16320 - DNA, 321 bp, Artificial Sequence
  Description of Artificial Sequence: Synthetic polynucleotide
gaaacgacactcacgcagtctccagccaccctgtctttgtctccaggggaaggagccaccctctcctgcagggccagtcagagtgttagcagctccttagcctggtatcaacagaaacctggccaggctcccaggctcctcatctatgatgcatccaacagggccactggcatcccagccaggttcagtggcagtgggtctgggacagactacactctcaccatcagcagcctagagcctgaagattttgcagtttattactgtcaccagcgtagcaactggccgtacacttttggccaggggaccaaggtggagatcaaa

SEQ ID NO: 16321-16401 - skipped (81 entries)

SEQ ID NO: 16402 - protein, 120 aa, Artificial Sequence
  Description of Artificial Sequence: Synthetic polypeptide
EVQLVESGGGLIQPGGSLRLSCAASGFTVTDNYMSWVRQAPGKGLEWVSVLYSGGSTYYADAVQGRFSISRDNSKNALYLQMNSLRAEDTAVYYCARGFGNGWSYYFDYWGQGTLVTVSS

SEQ ID NO: 16403 - protein, 26 aa, Artificial Sequence
  Description of Artificial Sequence: Synthetic peptide
EVQLVESGGGLIQPGGSLRLSCAASG

SEQ ID NO: 16404 - protein, 9 aa, Artificial Sequence
  Description of Artificial Sequence: Synthetic peptide
FTVTDNYMS

SEQ ID NO: 16405 - protein, 14 aa, Artificial Sequence
  Description of Artificial Sequence: Synthetic peptide
WVRQAPGKGLEWVS

SEQ ID NO: 16406 - protein, 16 aa, Artificial Sequence
  Description of Artificial Sequence: Synthetic peptide
VLYSGGSTYYADAVQG

SEQ ID NO: 16407 - protein, 30 aa, Artificial Sequence
  Description of Artificial Sequence: Synthetic polypeptide
RFSISRDNSKNALYLQMNSLRAEDTAVYYC

SEQ ID NO: 16408 - protein, 14 aa, Artificial Sequence
  Description of Artificial Sequence: Synthetic peptide
ARGFGNGWSYYFDY

SEQ ID NO: 16409 - protein, 11 aa, Artificial Sequence
  Description of Artificial Sequence: Synthetic peptide
WGQGTLVTVSS

SEQ ID NO: 16410 - DNA, 360 bp, Artificial Sequence
  Description of Artificial Sequence: Synthetic polynucleotide
gaggtgcagctggtggagtctggaggaggcttgatccagcctggggggtccctgagactctcctgtgcagcctctgggttcaccgtcactgacaactacatgagttgggtccgccaggctccagggaaggggctggagtgggtctcagttctttatagcggtggtagcacgtactacgcagacgccgtgcagggccgattctccatctccagagacaattccaagaacgctctgtatcttcaaatgaacagcctgagggccgaggacacggccgtctattactgtgcgaggggatttggtaatggctggtcgtactactttgactactggggccagggaaccctggtcaccgtctcctca

SEQ ID NO: 16411 - skipped

SEQ ID NO: 16412 - protein, 107 aa, Artificial Sequence
  Description of Artificial Sequence: Synthetic polypeptide
DIVLTQTPSSLSASVGDRVTITCRASQTIATYLSWYQQKPGKAPKLLIYAVSSLQSGVPSRFSGSGSGTDFTLTIGSLQPEDFATYYCQQSYSIPWTFGQGTKVDIK

SEQ ID NO: 16413 - protein, 23 aa, Artificial Sequence
  Description of Artificial Sequence: Synthetic peptide
DIVLTQTPSSLSASVGDRVTITC

SEQ ID NO: 16414 - protein, 11 aa, Artificial Sequence
  Description of Artificial Sequence: Synthetic peptide
RASQTIATYLS

SEQ ID NO: 16415 - protein, 15 aa, Artificial Sequence
  Description of Artificial Sequence: Synthetic peptide
WYQQKPGKAPKLLIY

SEQ ID NO: 16416 - protein, 7 aa, Artificial Sequence
  Description of Artificial Sequence: Synthetic peptide
AVSSLQS

SEQ ID NO: 16417 - protein, 32 aa, Artificial Sequence; identical to SEQ ID NO: 11117
  Description of Artificial Sequence: Synthetic polypeptide

SEQ ID NO: 16418 - protein, 9 aa, Artificial Sequence
  Description of Artificial Sequence: Synthetic peptide
QQSYSIPWT

SEQ ID NO: 16419 - protein, 10 aa, Artificial Sequence
  Description of Artificial Sequence: Synthetic peptide
FGQGTKVDIK

SEQ ID NO: 16420 - DNA, 321 bp, Artificial Sequence
  Description of Artificial Sequence: Synthetic polynucleotide
gatattgtgctgactcagactccatcctccctgtctgcatctgtaggagacagagtcaccatcacttgccgggcaagtcagaccattgccacctatttaagttggtatcagcagaaaccagggaaagcccctaaactcctgatctatgctgtatccagtttacaaagtggagtcccatcaaggttcagtggcagtggatctgggacagacttcactctcaccatcggcagtctgcaacctgaagattttgcaacttactactgtcaacagagttacagtatcccgtggacgttcggccaagggaccaaagtggatatcaaa

SEQ ID NO: 16421-16501 - skipped (81 entries)

SEQ ID NO: 16502 - protein, 129 aa, Artificial Sequence
  Description of Artificial Sequence: Synthetic polypeptide
EVQLVQSGGGLVQPGGSLRLSCAASGFTFSSYSMSWVRQAPGKGLEWVSYITRSSDNIYYAESVKGRFTISRDSAKNSLYLHMNSLRDEDTAVYYCARDPGLEYSGNYFSYYYYAMDVWGQGTTVTVSS

SEQ ID NO: 16503 - protein, 26 aa, Artificial Sequence
  Description of Artificial Sequence: Synthetic peptide
EVQLVQSGGGLVQPGGSLRLSCAASG

SEQ ID NO: 16504 - protein, 9 aa, Artificial Sequence
  Description of Artificial Sequence: Synthetic peptide
FTFSSYSMS

SEQ ID NO: 16505 - protein, 14 aa, Artificial Sequence
  Description of Artificial Sequence: Synthetic peptide
WVRQAPGKGLEWVS

SEQ ID NO: 16506 - protein, 17 aa, Artificial Sequence
  Description of Artificial Sequence: Synthetic peptide
YITRSSDNIYYAESVKG

SEQ ID NO: 16507 - protein, 30 aa, Artificial Sequence
  Description of Artificial Sequence: Synthetic polypeptide
RFTISRDSAKNSLYLHMNSLRDEDTAVYYC

SEQ ID NO: 16508 - protein, 22 aa, Artificial Sequence
  Description of Artificial Sequence: Synthetic peptide
ARDPGLEYSGNYFSYYYYAMDV

SEQ ID NO: 16509 - protein, 11 aa, Artificial Sequence
  Description of Artificial Sequence: Synthetic peptide
WGQGTTVTVSS

SEQ ID NO: 16510 - DNA, 387 bp, Artificial Sequence
  Description of Artificial Sequence: Synthetic polynucleotide
gaggtgcagctggtgcagtctgggggaggcttggtccagcctggggggtccctgagactctcctgtgcagcctctggattcaccttcagtagctatagcatgagctgggtccgccaggctccagggaaggggctggagtgggtttcatacattactagaagtagtgataacatatactacgcagagtctgtgaagggccgattcaccatctccagagacagtgccaagaactcactgtatctgcacatgaacagcctgagagacgaggacacggctgtgtattactgtgcgagagatcccggactagaatatagtgggaactacttttcgtactactactacgctatggacgtctggggccaagggaccacggtcaccgtctcttca

SEQ ID NO: 16511 - skipped

SEQ ID NO: 16512 - protein, 108 aa, Artificial Sequence
  Description of Artificial Sequence: Synthetic polypeptide
EIVMTQSPSSLSASVGDRVTITCRASQSISYYLNWYQQKPGKAPKLLIYAASSLQSGVPSRFSGSGSGTDFILTISSLQPEDIATYYCQHSYSSPPLTFGGGTKVEIK

SEQ ID NO: 16513 - protein, 23 aa, Artificial Sequence
  Description of Artificial Sequence: Synthetic peptide
EIVMTQSPSSLSASVGDRVTITC

SEQ ID NO: 16514 - protein, 11 aa, Artificial Sequence
  Description of Artificial Sequence: Synthetic peptide
RASQSISYYLN

SEQ ID NO: 16515 - protein, 15 aa, Artificial Sequence
  Description of Artificial Sequence: Synthetic peptide
WYQQKPGKAPKLLIY

SEQ ID NO: 16516 - protein, 7 aa, Artificial Sequence
  Description of Artificial Sequence: Synthetic peptide
AASSLQS

SEQ ID NO: 16517 - protein, 32 aa, Artificial Sequence
  Description of Artificial Sequence: Synthetic polypeptide
GVPSRFSGSGSGTDFILTISSLQPEDIATYYC

SEQ ID NO: 16518 - protein, 10 aa, Artificial Sequence
  Description of Artificial Sequence: Synthetic peptide
QHSYSSPPLT

SEQ ID NO: 16519 - protein, 10 aa, Artificial Sequence
  Description of Artificial Sequence: Synthetic peptide
FGGGTKVEIK

SEQ ID NO: 16520 - DNA, 324 bp, Artificial Sequence
  Description of Artificial Sequence: Synthetic polynucleotide
gaaattgtaatgacgcagtctccatcctccctgtctgcatctgtaggagacagagtcaccatcacttgccgggcaagtcagagcattagctactatttaaattggtatcagcagaaaccagggaaagcccctaagctcctgatctatgctgcatccagtttgcaaagtggggtcccatcaaggttcagtggcagtggatctgggacagatttcattctcaccatcagcagtctgcagcctgaagatattgcaacttactactgtcaacacagttacagtagccctccgctcactttcggcggagggaccaaggtggagatcaaa

SEQ ID NO: 16521-16601 - skipped (81 entries)

SEQ ID NO: 16602 - protein, 129 aa, Artificial Sequence
  Description of Artificial Sequence: Synthetic polypeptide
QVQLVQSGAEVKKPGSSVKVSCKASGGTFSTHAISWVRQAPGHGPEWMGGIIPLFGTSESAQRFQARVRFTADESTSTAYMELSSLTSEDTAVYYCVRDSDPYTATSRNNHYWYDMDVWGQGTTVTVSS

SEQ ID NO: 16603 - protein, 26 aa, Artificial Sequence
  Description of Artificial Sequence: Synthetic peptide
QVQLVQSGAEVKKPGSSVKVSCKASG

SEQ ID NO: 16604 - protein, 9 aa, Artificial Sequence
  Description of Artificial Sequence: Synthetic peptide
GTFSTHAIS

SEQ ID NO: 16605 - protein, 14 aa, Artificial Sequence
  Description of Artificial Sequence: Synthetic peptide
WVRQAPGHGPEWMG

SEQ ID NO: 16606 - protein, 17 aa, Artificial Sequence
  Description of Artificial Sequence: Synthetic peptide
GIIPLFGTSESAQRFQA

SEQ ID NO: 16607 - protein, 30 aa, Artificial Sequence
  Description of Artificial Sequence: Synthetic polypeptide
RVRFTADESTSTAYMELSSLTSEDTAVYYC

SEQ ID NO: 16608 - protein, 22 aa, Artificial Sequence
  Description of Artificial Sequence: Synthetic peptide
VRDSDPYTATSRNNHYWYDMDV

SEQ ID NO: 16609 - protein, 11 aa, Artificial Sequence
  Description of Artificial Sequence: Synthetic peptide
WGQGTTVTVSS

SEQ ID NO: 16610 - DNA, 387 bp, Artificial Sequence
  Description of Artificial Sequence: Synthetic polynucleotide
caggtccagcttgtacagtctggggctgaagtgaagaagcctgggtcctcggtgaaggtctcctgcaaggcttctggaggcaccttcagcacccacgctatcagctgggtgcgacaggcccctggacatgggcctgagtggatgggagggatcatccctctttttggtacatcagaatccgcacagaggttccaggccagagtcagatttaccgcggacgaatccacgagcacagcctacatggagttgagcagcctgacatctgaagacacggccgtgtattactgtgtgagagactctgacccctatacggcgactagcaggaataatcactactggtatgatatggacgtctggggccaagggaccacggtcaccgtctcctca

SEQ ID NO: 16611 - skipped

SEQ ID NO: 16612 - protein, 112 aa, Artificial Sequence
  Description of Artificial Sequence: Synthetic polypeptide
ETTLTQSPLSLPVTLGQPASISCRSSQIVVHSDGNTYLNWFHQRPGQSPRRLIYKVSNRDSGVPDRFSGSGSGTDFTLKISRVEAEDIGVYYCMQGTDWPRTFGQGTKVDIK

SEQ ID NO: 16613 - protein, 23 aa, Artificial Sequence
  Description of Artificial Sequence: Synthetic peptide
ETTLTQSPLSLPVTLGQPASISC

SEQ ID NO: 16614 - protein, 16 aa, Artificial Sequence
  Description of Artificial Sequence: Synthetic peptide
RSSQIVVHSDGNTYLN

SEQ ID NO: 16615 - protein, 15 aa, Artificial Sequence
  Description of Artificial Sequence: Synthetic peptide
WFHQRPGQSPRRLIY

SEQ ID NO: 16616 - protein, 7 aa, Artificial Sequence
  Description of Artificial Sequence: Synthetic peptide
KVSNRDS

SEQ ID NO: 16617 - protein, 32 aa, Artificial Sequence; identical to SEQ ID NO: 1317
  Description of Artificial Sequence: Synthetic polypeptide

SEQ ID NO: 16618 - protein, 9 aa, Artificial Sequence
  Description of Artificial Sequence: Synthetic peptide
MQGTDWPRT

SEQ ID NO: 16619 - protein, 10 aa, Artificial Sequence
  Description of Artificial Sequence: Synthetic peptide
FGQGTKVDIK

SEQ ID NO: 16620 - DNA, 336 bp, Artificial Sequence
  Description of Artificial Sequence: Synthetic polynucleotide
gaaacgacactcacgcagtctccgctctccctgcccgtcacccttggacagccggcctccatctcctgcaggtctagtcaaatcgtcgtacacagtgatggaaacacctacttgaattggtttcaccagaggccaggccaatctccaaggcgcctgatttataaggtttctaatcgggactctggggtcccagacagattcagcggcagtgggtcaggcactgacttcacactgaaaatcagcagggtggaggctgaagatattggggtttattactgcatgcaaggtacagactggcctcggacttttggccaggggaccaaagtggatatcaaa

SEQ ID NO: 16621-16701 - skipped (81 entries)

SEQ ID NO: 16702 - protein, 126 aa, Artificial Sequence
  Description of Artificial Sequence: Synthetic polypeptide
QVQLVQSGAEVKKPGSSVKVSCKVSGGRFSDYAISWLRQAPVKGLEWMGGIIPRLNRKGYSQDFQGRLTFTADESTSTAYMELSGLTSEDTAVYYCARDPTFLNSGNHFWYAVDIWGQGTTVTVSS

SEQ ID NO: 16703 - protein, 26 aa, Artificial Sequence
  Description of Artificial Sequence: Synthetic peptide
QVQLVQSGAEVKKPGSSVKVSCKVSG

SEQ ID NO: 16704 - protein, 9 aa, Artificial Sequence
  Description of Artificial Sequence: Synthetic peptide
GRFSDYAIS

SEQ ID NO: 16705 - protein, 14 aa, Artificial Sequence
  Description of Artificial Sequence: Synthetic peptide
WLRQAPVKGLEWMG

SEQ ID NO: 16706 - protein, 17 aa, Artificial Sequence
  Description of Artificial Sequence: Synthetic peptide
GIIPRLNRKGYSQDFQG

SEQ ID NO: 16707 - protein, 30 aa, Artificial Sequence; identical to SEQ ID NO: 3707
  Description of Artificial Sequence: Synthetic polypeptide

SEQ ID NO: 16708 - protein, 19 aa, Artificial Sequence
  Description of Artificial Sequence: Synthetic peptide
ARDPTFLNSGNHFWYAVDI

SEQ ID NO: 16709 - protein, 11 aa, Artificial Sequence
  Description of Artificial Sequence: Synthetic peptide
WGQGTTVTVSS

SEQ ID NO: 16710 - DNA, 378 bp, Artificial Sequence
  Description of Artificial Sequence: Synthetic polynucleotide
caggtccagctggtgcagtctggggctgaagtgaagaagcctgggtcctcggtgaaggtctcctgtaaggtttccggagggagattcagtgattacgctatcagctggctgcgacaggcccccgtaaaaggactcgagtggatggggggaatcatccctcgtctaaatagaaaaggatactcacaggatttccagggcagactcacctttactgcggacgagtccaccagcaccgcctacatggaattgagtggcctgacgtctgaagacacggccgtttattactgtgcaagagatccgacttttcttaacagtggaaatcacttctggtatgctgttgatatctggggccaagggaccacggtcactgtctcctca

SEQ ID NO: 16711 - skipped

SEQ ID NO: 16712 - protein, 112 aa, Artificial Sequence
  Description of Artificial Sequence: Synthetic polypeptide
DIRLTQSPLSLSVTLGQAASISCTCSQTAVHSDGNTYLNWFHQRPGQSPRRLIYKVSNRDSGVPDRFSGSGSGTDFTLKISRVEAEDVGIYYCMQTTDWPRTFGQGTKVEIK

SEQ ID NO: 16713 - protein, 23 aa, Artificial Sequence
  Description of Artificial Sequence: Synthetic peptide
DIRLTQSPLSLSVTLGQAASISC

SEQ ID NO: 16714 - protein, 16 aa, Artificial Sequence
  Description of Artificial Sequence: Synthetic peptide
TCSQTAVHSDGNTYLN

SEQ ID NO: 16715 - protein, 15 aa, Artificial Sequence
  Description of Artificial Sequence: Synthetic peptide
WFHQRPGQSPRRLIY

SEQ ID NO: 16716 - protein, 7 aa, Artificial Sequence
  Description of Artificial Sequence: Synthetic peptide
KVSNRDS

SEQ ID NO: 16717 - protein, 32 aa, Artificial Sequence; identical to SEQ ID NO: 1517
  Description of Artificial Sequence: Synthetic polypeptide

SEQ ID NO: 16718 - protein, 9 aa, Artificial Sequence
  Description of Artificial Sequence: Synthetic peptide
MQTTDWPRT

SEQ ID NO: 16719 - protein, 10 aa, Artificial Sequence
  Description of Artificial Sequence: Synthetic peptide
FGQGTKVEIK

SEQ ID NO: 16720 - DNA, 336 bp, Artificial Sequence
  Description of Artificial Sequence: Synthetic polynucleotide
gacatccggttgacccagtctccactctccctgtccgtcacccttggacaggcggcctccatctcctgcacctgtagtcaaacggccgtgcactctgatggaaacacctacctgaattggtttcaccagaggccaggccaatctccaaggcgcctcatttataaggtttctaatcgggactctggggtcccagacagattcagcggcagtgggtcaggcactgatttcacactgaaaatcagcagggtggaggctgaggatgttggaatttattactgcatgcaaactacagactggcctcggacgttcggccaagggaccaaggtggagatcaaa

SEQ ID NO: 16721-16801 - skipped (81 entries)

SEQ ID NO: 16802 - protein, 120 aa, Artificial Sequence
  Description of Artificial Sequence: Synthetic polypeptide
EVQLVESGGGVVKPGGSLRVSCVGSGFTFSDHYMSWIRQAPGKGLEIISYISTDGSYINDADSVKGRFINSRDNAKNSVYLQLNSLRAEDTAVYYCARMGPSGSGSLDYWGQGSLVTVSS

SEQ ID NO: 16803 - protein, 26 aa, Artificial Sequence
  Description of Artificial Sequence: Synthetic peptide
EVQLVESGGGVVKPGGSLRVSCVGSG

SEQ ID NO: 16804 - protein, 9 aa, Artificial Sequence
  Description of Artificial Sequence: Synthetic peptide
FTFSDHYMS

SEQ ID NO: 16805 - protein, 14 aa, Artificial Sequence
  Description of Artificial Sequence: Synthetic peptide
WIRQAPGKGLEIIS

SEQ ID NO: 16806 - protein, 17 aa, Artificial Sequence
  Description of Artificial Sequence: Synthetic peptide
YISTDGSYINDADSVKG

SEQ ID NO: 16807 - protein, 30 aa, Artificial Sequence
  Description of Artificial Sequence: Synthetic polypeptide
RFINSRDNAKNSVYLQLNSLRAEDTAVYYC

SEQ ID NO: 16808 - protein, 13 aa, Artificial Sequence
  Description of Artificial Sequence: Synthetic peptide
ARMGPSGSGSLDY

SEQ ID NO: 16809 - protein, 11 aa, Artificial Sequence
  Description of Artificial Sequence: Synthetic peptide
WGQGSLVTVSS

SEQ ID NO: 16810 - DNA, 360 bp, Artificial Sequence
  Description of Artificial Sequence: Synthetic polynucleotide
gaggtgcagctggtggagtccgggggaggcgtggtcaagcctggagggtccctgagagtctcctgtgtaggctctggattcactttcagtgaccactacatgagttggatccgccaggctccagggaaggggctggagataatttcatatattagtacggatgggtcgtatataaatgacgcagactctgtgaagggccgattcatcaactccagagacaacgccaagaattcagtgtatctgcaattgaacagcctgagagccgaggacacggctgtctactactgtgcgagaatgggccccagcggttcggggagccttgactactggggccagggatccctggtcaccgtctcttca

SEQ ID NO: 16811 - skipped

SEQ ID NO: 16812 - protein, 107 aa, Artificial Sequence
  Description of Artificial Sequence: Synthetic polypeptide
DIVMTQSPGTLSLSPGERAALSCRASQIVTRSQLAWYQHKPGQPPRLLIYDSSSRATGTPDRFSGSGSGTDFTLTISRLEPEDSAVYYCHQYSGSATFGPGTKVEIK

SEQ ID NO: 16813 - protein, 23 aa, Artificial Sequence
  Description of Artificial Sequence: Synthetic peptide
DIVMTQSPGTLSLSPGERAALSC

SEQ ID NO: 16814 - protein, 12 aa, Artificial Sequence
  Description of Artificial Sequence: Synthetic peptide
RASQIVTRSQLA

SEQ ID NO: 16815 - protein, 15 aa, Artificial Sequence
  Description of Artificial Sequence: Synthetic peptide
WYQHKPGQPPRLLIY

SEQ ID NO: 16816 - protein, 7 aa, Artificial Sequence
  Description of Artificial Sequence: Synthetic peptide
DSSSRAT

SEQ ID NO: 16817 - protein, 32 aa, Artificial Sequence
  Description of Artificial Sequence: Synthetic polypeptide
GTPDRFSGSGSGTDFTLTISRLEPEDSAVYYC

SEQ ID NO: 16818 - protein, 8 aa, Artificial Sequence
  Description of Artificial Sequence: Synthetic peptide
HQYSGSAT

SEQ ID NO: 16819 - protein, 10 aa, Artificial Sequence
  Description of Artificial Sequence: Synthetic peptide
FGPGTKVEIK

SEQ ID NO: 16820 - DNA, 321 bp, Artificial Sequence
  Description of Artificial Sequence: Synthetic polynucleotide
gatattgtgatgacccagtctccaggcaccctgtctttgtctccaggggaaagagccgccctctcctgcagggccagtcaaattgttactagaagccagttagcctggtaccagcataaacctggccagcctcccaggctcctcatctacgattcatccagcagggccactggcaccccagacaggttcagtggcagtgggtctgggacagacttcactctcaccattagtagactggagcctgaagattctgcagtttattactgtcaccaatatagtgggtctgcgacgttcggcccagggaccaaggtggaaatcaaa

SEQ ID NO: 16821-16901 - skipped (81 entries)

SEQ ID NO: 16902 - protein, 125 aa, Artificial Sequence
  Description of Artificial Sequence: Synthetic polypeptide
EVQLVESGPTLVKPTQTLTLTCTFSGFSLNTRELGVGWIRQPPGKALEWLALIYWDDDKRYSPSLKSRLSITKDTSKNQVVLTLTNMDPGDTATYYCAHTSELPPRRPYAAFDFWGQGTLVTVSS

SEQ ID NO: 16903 - protein, 26 aa, Artificial Sequence
  Description of Artificial Sequence: Synthetic peptide
EVQLVESGPTLVKPTQTLTLTCTFSG

SEQ ID NO: 16904 - protein, 11 aa, Artificial Sequence
  Description of Artificial Sequence: Synthetic peptide
FSLNTRELGVG

SEQ ID NO: 16905 - protein, 14 aa, Artificial Sequence
  Description of Artificial Sequence: Synthetic peptide
WIRQPPGKALEWLA

SEQ ID NO: 16906 - protein, 16 aa, Artificial Sequence
  Description of Artificial Sequence: Synthetic peptide
LIYWDDDKRYSPSLKS

SEQ ID NO: 16907 - protein, 30 aa, Artificial Sequence
  Description of Artificial Sequence: Synthetic polypeptide
RLSITKDTSKNQVVLTLTNMDPGDTATYYC

SEQ ID NO: 16908 - protein, 17 aa, Artificial Sequence
  Description of Artificial Sequence: Synthetic peptide
AHTSELPPRRPYAAFDF

SEQ ID NO: 16909 - protein, 11 aa, Artificial Sequence
  Description of Artificial Sequence: Synthetic peptide
WGQGTLVTVSS

SEQ ID NO: 16910 - DNA, 375 bp, Artificial Sequence
  Description of Artificial Sequence: Synthetic polynucleotide
gaggtgcagctggtggagtctggtcctacgctggtgaaacccacacagaccctcacgctgacctgcaccttctctgggttctcactcaacactagagaactgggtgtgggctggatccgtcagcccccaggaaaggccctggagtggcttgcactcatttattgggatgatgataagcgctacagtccatctctgaagagcagactctccatcaccaaggacacctccaaaaaccaggtggtccttacactgaccaacatggaccctggtgacacagccacatattactgtgcacacacctcagaattgcccccccgacgaccgtatgccgcctttgacttctggggccagggaaccctggtcaccgtctcttca

SEQ ID NO: 16911 - skipped

SEQ ID NO: 16912 - protein, 110 aa, Artificial Sequence
  Description of Artificial Sequence: Synthetic polypeptide
SYELTQPPSVSGAPRQKVTISCSGSSANIASNGVNWYQQLPGKAPKLLIYYDDLVSSGVSDRFSGSKSGTSASLAISGLQSEDEADYYCATWDDILNGPVFGGGTKLTVL

SEQ ID NO: 16913 - protein, 22 aa, Artificial Sequence
  Description of Artificial Sequence: Synthetic peptide
SYELTQPPSVSGAPRQKVTISC

SEQ ID NO: 16914 - protein, 13 aa, Artificial Sequence
  Description of Artificial Sequence: Synthetic peptide
SGSSANIASNGVN

SEQ ID NO: 16915 - protein, 15 aa, Artificial Sequence
  Description of Artificial Sequence: Synthetic peptide
WYQQLPGKAPKLLIY

SEQ ID NO: 16916 - protein, 7 aa, Artificial Sequence
  Description of Artificial Sequence: Synthetic peptide
YDDLVSS

SEQ ID NO: 16917 - protein, 32 aa, Artificial Sequence
  Description of Artificial Sequence: Synthetic polypeptide
GVSDRFSGSKSGTSASLAISGLQSEDEADYYC

SEQ ID NO: 16918 - protein, 11 aa, Artificial Sequence
  Description of Artificial Sequence: Synthetic peptide
ATWDDILNGPV

SEQ ID NO: 16919 - protein, 10 aa, Artificial Sequence
  Description of Artificial Sequence: Synthetic peptide
FGGGTKLTVL

SEQ ID NO: 16920 - DNA, 330 bp, Artificial Sequence
  Description of Artificial Sequence: Synthetic polynucleotide
tcctatgagctgacacagccaccctcggtgtctggagcccccaggcagaaggtcaccatctcctgttctggaagcagcgccaacatcgcaagcaacggtgtgaactggtaccagcagctcccaggaaaggctcccaaactcctcatctactatgatgatctggtgtcctcaggggtctctgaccgattctctggctccaagtctggcacctcagcctccctggccatcagtgggctccagtctgaggatgaggctgattattactgtgcaacgtgggatgacatcctgaatggtccggtattcggcggagggaccaagctcaccgtccta

SEQ ID NO: 16921-17001 - skipped (81 entries)

SEQ ID NO: 17002 - protein, 116 aa, Artificial Sequence
  Description of Artificial Sequence: Synthetic polypeptide
EVQLVESGGGVVQPGGSLRLSCVASGFPFGRYAMHWVRQAPGQGLEWLTLISFDSSNIEYSDSVQGRFTISRDNSRNTLFLQMTSLRPEDTAVYFCARDLPPLDYWGQGTLVTVSS

SEQ ID NO: 17003 - protein, 26 aa, Artificial Sequence
  Description of Artificial Sequence: Synthetic peptide
EVQLVESGGGVVQPGGSLRLSCVASG

SEQ ID NO: 17004 - protein, 9 aa, Artificial Sequence
  Description of Artificial Sequence: Synthetic peptide
FPFGRYAMH

SEQ ID NO: 17005 - protein, 14 aa, Artificial Sequence
  Description of Artificial Sequence: Synthetic peptide
WVRQAPGQGLEWLT

SEQ ID NO: 17006 - protein, 17 aa, Artificial Sequence
  Description of Artificial Sequence: Synthetic peptide
LISFDSSNIEYSDSVQG

SEQ ID NO: 17007 - protein, 30 aa, Artificial Sequence
  Description of Artificial Sequence: Synthetic polypeptide
RFTISRDNSRNTLFLQMTSLRPEDTAVYFC

SEQ ID NO: 17008 - protein, 9 aa, Artificial Sequence
  Description of Artificial Sequence: Synthetic peptide
ARDLPPLDY

SEQ ID NO: 17009 - protein, 11 aa, Artificial Sequence
  Description of Artificial Sequence: Synthetic peptide
WGQGTLVTVSS

SEQ ID NO: 17010 - DNA, 348 bp, Artificial Sequence
  Description of Artificial Sequence: Synthetic polynucleotide
gaggtgcagctggtggagtctgggggaggcgtggtccaacctggggggtccctgagactctcctgtgtggcctctggattccccttcggccgctatgccatgcactgggtccgccaggcccctggccaggggctggagtggctgacactcatctcatttgattcaagcaatatagaatactcagactccgtgcagggccgattcaccatctccagagacaattccaggaacacattgtttctgcaaatgaccagcctgagacctgaggacacggctgtatatttctgtgcgagagacctccctccccttgactactggggccagggaaccctggtcactgtctcctca

SEQ ID NO: 17011 - skipped

SEQ ID NO: 17012 - protein, 107 aa, Artificial Sequence
  Description of Artificial Sequence: Synthetic polypeptide
DIRMTQSPSSLSASVGDRVTITCRASQGFGNKVAWYQQKPGTAPKLLIYETSTLQSGVPSRFSGSGSGTEFAFTISSLQPEDGATYYCQKYNRAPWTFGQGTKVEIK

SEQ ID NO: 17013 - protein, 23 aa, Artificial Sequence
  Description of Artificial Sequence: Synthetic peptide
DIRMTQSPSSLSASVGDRVTITC

SEQ ID NO: 17014 - protein, 11 aa, Artificial Sequence
  Description of Artificial Sequence: Synthetic peptide
RASQGFGNKVA

SEQ ID NO: 17015 - protein, 15 aa, Artificial Sequence
  Description of Artificial Sequence: Synthetic peptide
WYQQKPGTAPKLLIY

SEQ ID NO: 17016 - protein, 7 aa, Artificial Sequence
  Description of Artificial Sequence: Synthetic peptide
ETSTLQS

SEQ ID NO: 17017 - protein, 32 aa, Artificial Sequence
  Description of Artificial Sequence: Synthetic polypeptide
GVPSRFSGSGSGTEFAFTISSLQPEDGATYYC

SEQ ID NO: 17018 - protein, 9 aa, Artificial Sequence
  Description of Artificial Sequence: Synthetic peptide
QKYNRAPWT

SEQ ID NO: 17019 - protein, 10 aa, Artificial Sequence
  Description of Artificial Sequence: Synthetic peptide
FGQGTKVEIK

SEQ ID NO: 17020 - DNA, 321 bp, Artificial Sequence
  Description of Artificial Sequence: Synthetic polynucleotide
gacatccggatgacccagtctccatcctccctgtctgcatctgtgggagacagagtcaccatcacttgccgggcgagtcagggcttcggcaataaagtagcctggtatcaacaaaaaccagggacagctcctaaactgttgatctacgaaacatctactttgcaatcaggggtcccatctcggttcagcggcagtggatctgggacagagttcgctttcaccatcagcagcctgcagcctgaagatggtgcgacttattactgtcaaaagtataaccgtgccccgtggacgttcggccaagggaccaaggtggaaatcaaa

SEQ ID NO: 17021-17101 - skipped (81 entries)

SEQ ID NO: 17102 - protein, 126 aa, Artificial Sequence
  Description of Artificial Sequence: Synthetic polypeptide
QVQLQQWGAGLLKPSETLSLTCAVNGGSFNNYYWSWIRQPPGKGPEWIGEVVHSGSTTYNPSLKSRVTISIDMSKNQFALKLNSVTAADTAVYYCARGFTFTYSDFLTGQRTFEYWGQGTLVTVSS

SEQ ID NO: 17103 - protein, 26 aa, Artificial Sequence
  Description of Artificial Sequence: Synthetic peptide
QVQLQQWGAGLLKPSETLSLTCAVNG

SEQ ID NO: 17104 - protein, 9 aa, Artificial Sequence
  Description of Artificial Sequence: Synthetic peptide
GSFNNYYWS

SEQ ID NO: 17105 - protein, 14 aa, Artificial Sequence
  Description of Artificial Sequence: Synthetic peptide
WIRQPPGKGPEWIG

SEQ ID NO: 17106 - protein, 16 aa, Artificial Sequence
  Description of Artificial Sequence: Synthetic peptide
EVVHSGSTTYNPSLKS

SEQ ID NO: 17107 - protein, 30 aa, Artificial Sequence
  Description of Artificial Sequence: Synthetic polypeptide
RVTISIDMSKNQFALKLNSVTAADTAVYYC

SEQ ID NO: 17108 - protein, 20 aa, Artificial Sequence
  Description of Artificial Sequence: Synthetic peptide
ARGFTFTYSDFLTGQRTFEY

SEQ ID NO: 17109 - protein, 11 aa, Artificial Sequence
  Description of Artificial Sequence: Synthetic peptide
WGQGTLVTVSS

SEQ ID NO: 17110 - DNA, 378 bp, Artificial Sequence
  Description of Artificial Sequence: Synthetic polynucleotide
caggtgcagctacagcagtggggcgcgggactgttgaagccttcggagaccctgtccctcacctgcgctgtcaatggtggatccttcaataattactattggagctggatccgccagcccccagggaaggggccggagtggattggggaagtcgttcatagtggaagcaccacctacaacccgtccctcaagagtcgagtcaccatatcaatagacatgtccaagaaccagttcgccttgaagttgaactctgtgaccgccgcggacacggctgtgtattactgtgcgagaggcttcaccttcacgtattccgattttttgactggtcaaaggacttttgagtactggggccagggaaccctggtcaccgtctcctca

SEQ ID NO: 17111 - skipped

SEQ ID NO: 17112 - protein, 111 aa, Artificial Sequence
  Description of Artificial Sequence: Synthetic polypeptide
QSALIQPASVSGSPGQSITISCTGTSSDVGRYNYVSWYQQHPGKAPKLMIYDVSNRPSGVSNRFSGSKSGNTASLTISGLQAEDEAAYYCSSYISDIKLVVFGGGTKLTVL

SEQ ID NO: 17113 - protein, 22 aa, Artificial Sequence
  Description of Artificial Sequence: Synthetic peptide
QSALIQPASVSGSPGQSITISC

SEQ ID NO: 17114 - protein, 14 aa, Artificial Sequence
  Description of Artificial Sequence: Synthetic peptide
TGTSSDVGRYNYVS

SEQ ID NO: 17115 - protein, 15 aa, Artificial Sequence
  Description of Artificial Sequence: Synthetic peptide
WYQQHPGKAPKLMIY

SEQ ID NO: 17116 - protein, 7 aa, Artificial Sequence
  Description of Artificial Sequence: Synthetic peptide
DVSNRPS

SEQ ID NO: 17117 - protein, 32 aa, Artificial Sequence
  Description of Artificial Sequence: Synthetic polypeptide
GVSNRFSGSKSGNTASLTISGLQAEDEAAYYC

SEQ ID NO: 17118 - protein, 11 aa, Artificial Sequence
  Description of Artificial Sequence: Synthetic peptide
SSYISDIKLVV

SEQ ID NO: 17119 - protein, 10 aa, Artificial Sequence
  Description of Artificial Sequence: Synthetic peptide
FGGGTKLTVL

SEQ ID NO: 17120 - DNA, 333 bp, Artificial Sequence
  Description of Artificial Sequence: Synthetic polynucleotide
cagtctgccctgattcagcctgcctccgtgtctgggtctcctggacagtcgatcaccatctcctgcactggaaccagcagtgacgttggtcgttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgcttattactgcagctcatatataagtgatatcaaactggtggtattcggcggagggaccaagctgaccgtccta

SEQ ID NO: 17121-17201 - skipped (81 entries)

SEQ ID NO: 17202 - protein, 120 aa, Artificial Sequence
  Description of Artificial Sequence: Synthetic polypeptide
EVQLVESGGGVVQPGRSLRLSCAASGFTFSSYAMHWVRQAPGKGLEWVALISYDGDKKYYPDSVRGRFTISRDNSKNTLHLQMNSLRLEDTAVYYCARSYGGSYSTVGYWGQGALVTVSS

SEQ ID NO: 17203 - protein, 26 aa, Artificial Sequence
  Description of Artificial Sequence: Synthetic peptide
EVQLVESGGGVVQPGRSLRLSCAASG

SEQ ID NO: 17204 - protein, 9 aa, Artificial Sequence
  Description of Artificial Sequence: Synthetic peptide
FTFSSYAMH

SEQ ID NO: 17205 - protein, 14 aa, Artificial Sequence
  Description of Artificial Sequence: Synthetic peptide
WVRQAPGKGLEWVA

SEQ ID NO: 17206 - protein, 17 aa, Artificial Sequence
  Description of Artificial Sequence: Synthetic peptide
LISYDGDKKYYPDSVRG

SEQ ID NO: 17207 - protein, 30 aa, Artificial Sequence
  Description of Artificial Sequence: Synthetic polypeptide
RFTISRDNSKNTLHLQMNSLRLEDTAVYYC

SEQ ID NO: 17208 - protein, 13 aa, Artificial Sequence
  Description of Artificial Sequence: Synthetic peptide
ARSYGGSYSTVGY

SEQ ID NO: 17209 - protein, 11 aa, Artificial Sequence
  Description of Artificial Sequence: Synthetic peptide
WGQGALVTVSS

SEQ ID NO: 17210 - DNA, 360 bp, Artificial Sequence
  Description of Artificial Sequence: Synthetic polynucleotide
gaggtgcagctggtggagtctgggggaggcgtggtccagcctgggaggtccctgagactctcctgtgcagcctctggattcaccttcagtagttatgcaatgcactgggtccgccaggctccaggcaaggggctggagtgggtggctcttatatcatatgatggagacaaaaaatactacccagactccgtgaggggccgattcaccatctccagagacaattccaagaacacgctgcatctacaaatgaacagcctgagacttgaggacacggctgtgtattactgtgcgcgttcgtatggtgggagctactcgaccgtgggctactggggccagggagccctggtcaccgtctcttca

SEQ ID NO: 17211 - skipped

SEQ ID NO: 17212 - protein, 108 aa, Artificial Sequence
  Description of Artificial Sequence: Synthetic polypeptide
QSALIQPRSVSGSPGQSVTISCTGTSSDVGGSNYVSWYQQHPGKAPKLLVYDVTKRPSGVPDRFSGSKSGNTASLTISGLQAEDEADYYCCSYAGTYIFGTGTKLTVL

SEQ ID NO: 17213 - protein, 22 aa, Artificial Sequence
  Description of Artificial Sequence: Synthetic peptide
QSALIQPRSVSGSPGQSVTISC

SEQ ID NO: 17214 - protein, 14 aa, Artificial Sequence
  Description of Artificial Sequence: Synthetic peptide
TGTSSDVGGSNYVS

SEQ ID NO: 17215 - protein, 15 aa, Artificial Sequence
  Description of Artificial Sequence: Synthetic peptide
WYQQHPGKAPKLLVY

SEQ ID NO: 17216 - protein, 7 aa, Artificial Sequence
  Description of Artificial Sequence: Synthetic peptide
DVTKRPS

SEQ ID NO: 17217 - protein, 32 aa, Artificial Sequence
  Description of Artificial Sequence: Synthetic polypeptide
GVPDRFSGSKSGNTASLTISGLQAEDEADYYC

SEQ ID NO: 17218 - protein, 8 aa, Artificial Sequence
  Description of Artificial Sequence: Synthetic peptide
CSYAGTYI

SEQ ID NO: 17219 - protein, 10 aa, Artificial Sequence
  Description of Artificial Sequence: Synthetic peptide
FGTGTKLTVL

SEQ ID NO: 17220 - DNA, 324 bp, Artificial Sequence
  Description of Artificial Sequence: Synthetic polynucleotide
cagtctgccctgattcagcctcgctcagtgtccgggtctcctggacagtcagtcaccatctcctgcactggaaccagcagtgatgttggtggttctaactatgtctcctggtaccaacagcacccaggcaaagcccccaaactcttggtttatgatgtcactaagcggccctcaggggtccctgatcgcttctctggctccaagtctggcaacacggcctccctgaccatctctgggctccaggctgaggatgaggctgattattactgctgctcatatgcaggcacctacattttcggaactgggaccaagctcaccgtccta

SEQ ID NO: 17221-17301 - skipped (81 entries)

SEQ ID NO: 17302 - protein, 120 aa, Artificial Sequence
  Description of Artificial Sequence: Synthetic polypeptide
QVQLVQSGGDSVNPGGSLRLSCAGSGFSVRDVWMSWVRQAPGKGLEWIGRIKSEADGGSSDYRASLKDRFSIWRDASKNTLYLQVNGLQTEDTAIYFCSWNDVGWAFTFWGQGTLVTVSS

SEQ ID NO: 17303 - protein, 26 aa, Artificial Sequence
  Description of Artificial Sequence: Synthetic peptide
QVQLVQSGGDSVNPGGSLRLSCAGSG

SEQ ID NO: 17304 - protein, 9 aa, Artificial Sequence
  Description of Artificial Sequence: Synthetic peptide
FSVRDVWMS

SEQ ID NO: 17305 - protein, 14 aa, Artificial Sequence
  Description of Artificial Sequence: Synthetic peptide
WVRQAPGKGLEWIG

SEQ ID NO: 17306 - protein, 19 aa, Artificial Sequence
  Description of Artificial Sequence: Synthetic peptide
RIKSEADGGSSDYRASLKD

SEQ ID NO: 17307 - protein, 30 aa, Artificial Sequence
  Description of Artificial Sequence: Synthetic polypeptide
RFSIWRDASKNTLYLQVNGLQTEDTAIYFC

SEQ ID NO: 17308 - protein, 11 aa, Artificial Sequence
  Description of Artificial Sequence: Synthetic peptide
SWNDVGWAFTF

SEQ ID NO: 17309 - protein, 11 aa, Artificial Sequence
  Description of Artificial Sequence: Synthetic peptide
WGQGTLVTVSS

SEQ ID NO: 17310 - DNA, 360 bp, Artificial Sequence
  Description of Artificial Sequence: Synthetic polynucleotide
caggtccagctggtgcagtctgggggagactcagtgaaccctggggggtcacttagactctcctgtgcaggctctgggttcagtgtcagagatgtctggatgagctgggtccgccaggctcccgggaaggggctggagtggattggccgcattaaaagtgaggccgatggcgggtcctcggactaccgtgcgtccctgaaagacagattcagcatctggagagatgcttcaaagaacacattgtatctgcaagtgaatggcctgcaaaccgaggacacagcaatatatttctgttcctggaacgacgtgggctgggcgtttaccttttggggccagggaaccctggtcaccgtctcttca

SEQ ID NO: 17311 - skipped

SEQ ID NO: 17312 - protein, 110 aa, Artificial Sequence
  Description of Artificial Sequence: Synthetic polypeptide
QSVLTQPPSVSGSPGQSVSISCSGTSSDFGNYNRISWYQQTPGTAPKVIIYEVNSRPSGVPDRFSGSKSGNTASLTITGLQAEDEADYYCCSYRSDNTYIFGGGTKVTVL

SEQ ID NO: 17313 - protein, 22 aa, Artificial Sequence
  Description of Artificial Sequence: Synthetic peptide
QSVLTQPPSVSGSPGQSVSISC

SEQ ID NO: 17314 - protein, 14 aa, Artificial Sequence
  Description of Artificial Sequence: Synthetic peptide
SGTSSDFGNYNRIS

SEQ ID NO: 17315 - protein, 15 aa, Artificial Sequence
  Description of Artificial Sequence: Synthetic peptide
WYQQTPGTAPKVIIY

SEQ ID NO: 17316 - protein, 7 aa, Artificial Sequence
  Description of Artificial Sequence: Synthetic peptide
EVNSRPS

SEQ ID NO: 17317 - protein, 32 aa, Artificial Sequence
  Description of Artificial Sequence: Synthetic polypeptide
GVPDRFSGSKSGNTASLTITGLQAEDEADYYC

SEQ ID NO: 17318 - protein, 10 aa, Artificial Sequence
  Description of Artificial Sequence: Synthetic peptide
CSYRSDNTYI

SEQ ID NO: 17319 - protein, 10 aa, Artificial Sequence
  Description of Artificial Sequence: Synthetic peptide
FGGGTKVTVL

SEQ ID NO: 17320 - DNA, 330 bp, Artificial Sequence
  Description of Artificial Sequence: Synthetic polynucleotide
cagtctgtgctgactcagccaccctccgtgtccgggtctcctggacagtcagtcagcatctcctgcagtggaaccagcagtgactttggaaattataaccgtatttcctggtaccaacaaaccccaggcacagcccccaaggtcatcatttatgaggtcaatagtcggccctcaggggtccctgatcgcttctctgggtccaagtctggcaacacggcctccctgaccatcactgggctccaggctgaggacgaggctgattattattgctgctcatacagaagcgacaacacttacattttcggaggagggaccaaggtgaccgtccta

SEQ ID NO: 17321-17401 - skipped (81 entries)

SEQ ID NO: 17402 - protein, 124 aa, Artificial Sequence
  Description of Artificial Sequence: Synthetic polypeptide
QVQLVQSGAEVKKAGSSVKVSCKASGGPFSSFAISWVRQAPGQGLEWLGGIMTVFGPAHYAQKSRDRISITADESTSTSYLELSSLTSDDTAVYYCAAEERSGTNHNYYGLDVWGQGTTVTVSS

SEQ ID NO: 17403 - protein, 26 aa, Artificial Sequence
  Description of Artificial Sequence: Synthetic peptide
QVQLVQSGAEVKKAGSSVKVSCKASG

SEQ ID NO: 17404 - protein, 9 aa, Artificial Sequence
  Description of Artificial Sequence: Synthetic peptide
GPFSSFAIS

SEQ ID NO: 17405 - protein, 14 aa, Artificial Sequence
  Description of Artificial Sequence: Synthetic peptide
WVRQAPGQGLEWLG

SEQ ID NO: 17406 - protein, 17 aa, Artificial Sequence
  Description of Artificial Sequence: Synthetic peptide
GIMTVFGPAHYAQKSRD

SEQ ID NO: 17407 - protein, 30 aa, Artificial Sequence
  Description of Artificial Sequence: Synthetic polypeptide
RISITADESTSTSYLELSSLTSDDTAVYYC

SEQ ID NO: 17408 - protein, 17 aa, Artificial Sequence
  Description of Artificial Sequence: Synthetic peptide
AAEERSGTNHNYYGLDV

SEQ ID NO: 17409 - protein, 11 aa, Artificial Sequence
  Description of Artificial Sequence: Synthetic peptide
WGQGTTVTVSS

SEQ ID NO: 17410 - DNA, 372 bp, Artificial Sequence
  Description of Artificial Sequence: Synthetic polynucleotide
caggtgcagctggtgcagtctggggctgaggtgaagaaggctgggtcctcggtgaaggtctcctgcaaggcttctggaggccccttcagcagctttgctatcagttgggtgcgacaggcccctggacaagggcttgagtggctgggagggatcatgactgtcttcggtccagcacactacgcacagaagtctcgggacagaatctccattaccgcggacgaatccacgagcacatcctatctggaactgagcagcctgacatctgacgacacggccgtgtattattgtgcggcagaggaacgttcggggactaatcacaactactacggtctggacgtctggggccaagggaccacggtcaccgtctcctca

SEQ ID NO: 17411 - skipped

SEQ ID NO: 17412 - protein, 112 aa, Artificial Sequence
  Description of Artificial Sequence: Synthetic polypeptide
ETTLTQSPLFLPVTLGQPASISCRSSQRLVHTNGNTYLNWFQQRPGHSPRRLIYQVSNRDSGVPDRFSGSGSGTDFTLKISRVEAEDVGVYYCMQGTEWPRTFGGGTKLEIK

SEQ ID NO: 17413 - protein, 23 aa, Artificial Sequence
  Description of Artificial Sequence: Synthetic peptide
ETTLTQSPLFLPVTLGQPASISC

SEQ ID NO: 17414 - protein, 16 aa, Artificial Sequence
  Description of Artificial Sequence: Synthetic peptide
RSSQRLVHTNGNTYLN

SEQ ID NO: 17415 - protein, 15 aa, Artificial Sequence
  Description of Artificial Sequence: Synthetic peptide
WFQQRPGHSPRRLIY

SEQ ID NO: 17416 - protein, 7 aa, Artificial Sequence
  Description of Artificial Sequence: Synthetic peptide
QVSNRDS

SEQ ID NO: 17417 - protein, 32 aa, Artificial Sequence; identical to SEQ ID NO: 917
  Description of Artificial Sequence: Synthetic polypeptide

SEQ ID NO: 17418 - protein, 9 aa, Artificial Sequence
  Description of Artificial Sequence: Synthetic peptide
MQGTEWPRT

SEQ ID NO: 17419 - protein, 10 aa, Artificial Sequence
  Description of Artificial Sequence: Synthetic peptide
FGGGTKLEIK

SEQ ID NO: 17420 - DNA, 336 bp, Artificial Sequence
  Description of Artificial Sequence: Synthetic polynucleotide
gaaacgacactcacgcagtctccacttttcctgcccgtcacccttggacagccggcctccatctcctgcaggtctagtcaaaggctcgtgcacactaatggaaacacttacttgaattggtttcagcagaggccaggccactctccaaggcgcctgatttatcaggtttctaaccgggactctggggtcccagacagattcagcggcagtgggtcaggcacggatttcacactgaaaatcagcagggtggaggctgaggatgttggcgtttattactgcatgcaaggtacagagtggcctcggactttcggcggagggaccaagctggagatcaaa

SEQ ID NO: 17421-17501 - skipped (81 entries)

SEQ ID NO: 17502 - protein, 124 aa, Artificial Sequence
  Description of Artificial Sequence: Synthetic polypeptide
EVQLVESGGGLIQPGGSLRLSCAASGFPFSGTYMTWVRQAPGKGLEWVSIIYSGGDTYYADSVKGRFTISRDNSKNTLFLQMNSLRVEDTAMYYCARDREMAIITERSYGLDVWGQGTMVTVSS

SEQ ID NO: 17503 - protein, 26 aa, Artificial Sequence
  Description of Artificial Sequence: Synthetic peptide
EVQLVESGGGLIQPGGSLRLSCAASG

SEQ ID NO: 17504 - protein, 9 aa, Artificial Sequence
  Description of Artificial Sequence: Synthetic peptide
FPFSGTYMT

SEQ ID NO: 17505 - protein, 14 aa, Artificial Sequence
  Description of Artificial Sequence: Synthetic peptide
WVRQAPGKGLEWVS

SEQ ID NO: 17506 - protein, 16 aa, Artificial Sequence
  Description of Artificial Sequence: Synthetic peptide
IIYSGGDTYYADSVKG

SEQ ID NO: 17507 - protein, 30 aa, Artificial Sequence
  Description of Artificial Sequence: Synthetic polypeptide
RFTISRDNSKNTLFLQMNSLRVEDTAMYYC

SEQ ID NO: 17508 - protein, 18 aa, Artificial Sequence
  Description of Artificial Sequence: Synthetic peptide
ARDREMAIITERSYGLDV

SEQ ID NO: 17509 - protein, 11 aa, Artificial Sequence
  Description of Artificial Sequence: Synthetic peptide
WGQGTMVTVSS

SEQ ID NO: 17510 - DNA, 372 bp, Artificial Sequence
  Description of Artificial Sequence: Synthetic polynucleotide
gaggtgcagctggtggagtctggaggaggcttgatccagcctggggggtccctgagactctcctgtgcagcctctgggttccccttcagtggcacttacatgacctgggtccgccaggctccagggaaggggctggagtgggtctcaattatttatagcggtggtgacacatactacgcagactccgtgaagggccgattcaccatctccagagacaattccaagaacacgctgtttcttcaaatgaacagcctgagagtcgaggacacggccatgtattactgtgcgagagatcgggagatggctataattacagagcgttcctacggtttggacgtctggggccaagggaccatggtcaccgtctcttca

SEQ ID NO: 17511 - skipped

SEQ ID NO: 17512 - protein, 112 aa, Artificial Sequence
  Description of Artificial Sequence: Synthetic polypeptide
QPVLTQPPSASGTPGQRVTISCSGGSSNIGSNSVNWYQQLPGTAPKLLIYSNSQRPSGVPDRFSGSKSGTSASLAISGLQSEDEADYYCAAWDDSLNTFRYVFGTGTKVTVL

SEQ ID NO: 17513 - protein, 22 aa, Artificial Sequence
  Description of Artificial Sequence: Synthetic peptide
QPVLTQPPSASGTPGQRVTISC

SEQ ID NO: 17514 - protein, 13 aa, Artificial Sequence
  Description of Artificial Sequence: Synthetic peptide
SGGSSNIGSNSVN

SEQ ID NO: 17515 - protein, 15 aa, Artificial Sequence
  Description of Artificial Sequence: Synthetic peptide
WYQQLPGTAPKLLIY

SEQ ID NO: 17516 - protein, 7 aa, Artificial Sequence
  Description of Artificial Sequence: Synthetic peptide
SNSQRPS

SEQ ID NO: 17517 - protein, 32 aa, Artificial Sequence
  Description of Artificial Sequence: Synthetic polypeptide
GVPDRFSGSKSGTSASLAISGLQSEDEADYYC

SEQ ID NO: 17518 - protein, 13 aa, Artificial Sequence
  Description of Artificial Sequence: Synthetic peptide
AAWDDSLNTFRYV

SEQ ID NO: 17519 - protein, 10 aa, Artificial Sequence
  Description of Artificial Sequence: Synthetic peptide
FGTGTKVTVL

SEQ ID NO: 17520 - DNA, 336 bp, Artificial Sequence
  Description of Artificial Sequence: Synthetic polynucleotide
cagcctgtgctgactcagcctccctcagcgtctgggacccccgggcagagggtcaccatctcctgttctggaggcagctccaacatcggaagtaattctgtaaactggtaccagcagctcccaggaacggcccccaaactcctcatctatagtaatagtcagcggccctcaggggtccctgaccgattctctggctccaagtctggcacctcagcctccctggccatcagtgggctccagtctgaggatgaggctgattattactgtgcagcatgggatgacagccttaatactttccgctatgtcttcggaactgggaccaaggtcaccgtccta

SEQ ID NO: 17521-17601 - skipped (81 entries)

SEQ ID NO: 17602 - protein, 125 aa, Artificial Sequence
  Description of Artificial Sequence: Synthetic polypeptide
EVQLVESGGGLVQPGGSLRLSCGASGFTFSDYAMSWVRQAPGKGLEWVSTISGSGDKTYYADSLKGRFTNSRDNSKSTLYLQMTSLRAEDTAVYFCAKDRYCSGGSCFYDAFDIWGQGTTVTVSS

SEQ ID NO: 17603 - protein, 26 aa, Artificial Sequence
  Description of Artificial Sequence: Synthetic peptide
EVQLVESGGGLVQPGGSLRLSCGASG

SEQ ID NO: 17604 - protein, 9 aa, Artificial Sequence
  Description of Artificial Sequence: Synthetic peptide
FTFSDYAMS

SEQ ID NO: 17605 - protein, 14 aa, Artificial Sequence
  Description of Artificial Sequence: Synthetic peptide
WVRQAPGKGLEWVS

SEQ ID NO: 17606 - protein, 17 aa, Artificial Sequence
  Description of Artificial Sequence: Synthetic peptide
TISGSGDKTYYADSLKG

SEQ ID NO: 17607 - protein, 30 aa, Artificial Sequence
  Description of Artificial Sequence: Synthetic polypeptide
RFTNSRDNSKSTLYLQMTSLRAEDTAVYFC

SEQ ID NO: 17608 - protein, 18 aa, Artificial Sequence
  Description of Artificial Sequence: Synthetic peptide
AKDRYCSGGSCFYDAFDI

SEQ ID NO: 17609 - protein, 11 aa, Artificial Sequence
  Description of Artificial Sequence: Synthetic peptide
WGQGTTVTVSS

SEQ ID NO: 17610 - DNA, 375 bp, Artificial Sequence
  Description of Artificial Sequence: Synthetic polynucleotide
gaggtgcagctggtggagtctgggggaggcttggtacagcctggggggtccctgagactctcctgtggagcctctggattcacctttagcgactatgccatgagctgggtccgccaggctccagggaaggggctggagtgggtctcaacaattagtggaagtggtgataagacatactacgcggactccctgaagggccggttcaccaactccagagacaattccaagagcactctgtatctgcaaatgaccagcctgagagccgaggacacggccgtatatttctgtgcgaaagatcgctactgtagtggtggtagttgcttctatgatgcttttgatatctggggccaagggaccacggtcaccgtctcctca

SEQ ID NO: 17611 - skipped

SEQ ID NO: 17612 - protein, 107 aa, Artificial Sequence
  Description of Artificial Sequence: Synthetic polypeptide
ETTLTQSPSSLSASVGDRVNITCRASQSISTYLTWYQQKPGKAPKLLIYGASSLHSGVPSRFTGVGSGTEFTLSISSLQPEDFATYYCQQSYNTFFTFGGGTKVDIK

SEQ ID NO: 17613 - protein, 23 aa, Artificial Sequence
  Description of Artificial Sequence: Synthetic peptide
ETTLTQSPSSLSASVGDRVNITC

SEQ ID NO: 17614 - protein, 11 aa, Artificial Sequence
  Description of Artificial Sequence: Synthetic peptide
RASQSISTYLT

SEQ ID NO: 17615 - protein, 15 aa, Artificial Sequence
  Description of Artificial Sequence: Synthetic peptide
WYQQKPGKAPKLLIY

SEQ ID NO: 17616 - protein, 7 aa, Artificial Sequence
  Description of Artificial Sequence: Synthetic peptide
GASSLHS

SEQ ID NO: 17617 - protein, 32 aa, Artificial Sequence
  Description of Artificial Sequence: Synthetic polypeptide
GVPSRFTGVGSGTEFTLSISSLQPEDFATYYC

SEQ ID NO: 17618 - protein, 9 aa, Artificial Sequence
  Description of Artificial Sequence: Synthetic peptide
QQSYNTFFT

SEQ ID NO: 17619 - protein, 10 aa, Artificial Sequence
  Description of Artificial Sequence: Synthetic peptide
FGGGTKVDIK

SEQ ID NO: 17620 - DNA, 321 bp, Artificial Sequence
  Description of Artificial Sequence: Synthetic polynucleotide
gaaacgacactcacgcagtctccatcctccctgtctgcatctgtaggagacagagtcaatatcacttgccgggcaagtcagagcattagcacctatttaacttggtatcaacagaaaccagggaaagccccaaaactcttgatctatggtgcatccagtttgcacagtggggtcccatcaaggttcactggcgttggatctgggacagaattcactctcagcatcagcagtctgcaacctgaagattttgcaacttactactgtcaacagagttacaataccttcttcactttcggcggagggaccaaagtggatatcaaa

SEQ ID NO: 17621-17701 - skipped (81 entries)

SEQ ID NO: 17702 - protein, 122 aa, Artificial Sequence
  Description of Artificial Sequence: Synthetic polypeptide
EVQLVESGGGVVQPGRSLRLSCEASGFTFADYPMHWVRQAPGKGLEWVAVISSHGRSQGYAASVKGRFTFSRDNSQSSLFLQLNSLRVEDTAVYFCAREAQSSGRAGCLDAWGQGTLVTVSS

SEQ ID NO: 17703 - protein, 26 aa, Artificial Sequence
  Description of Artificial Sequence: Synthetic peptide
EVQLVESGGGVVQPGRSLRLSCEASG

SEQ ID NO: 17704 - protein, 9 aa, Artificial Sequence
  Description of Artificial Sequence: Synthetic peptide
FTFADYPMH

SEQ ID NO: 17705 - protein, 14 aa, Artificial Sequence
  Description of Artificial Sequence: Synthetic peptide
WVRQAPGKGLEWVA

SEQ ID NO: 17706 - protein, 17 aa, Artificial Sequence
  Description of Artificial Sequence: Synthetic peptide
VISSHGRSQGYAASVKG

SEQ ID NO: 17707 - protein, 30 aa, Artificial Sequence
  Description of Artificial Sequence: Synthetic polypeptide
RFTFSRDNSQSSLFLQLNSLRVEDTAVYFC

SEQ ID NO: 17708 - protein, 15 aa, Artificial Sequence
  Description of Artificial Sequence: Synthetic peptide
AREAQSSGRAGCLDA

SEQ ID NO: 17709 - protein, 11 aa, Artificial Sequence
  Description of Artificial Sequence: Synthetic peptide
WGQGTLVTVSS

SEQ ID NO: 17710 - DNA, 366 bp, Artificial Sequence
  Description of Artificial Sequence: Synthetic polynucleotide
gaggtgcagctggtggagtctgggggaggcgtggtccagcctgggcggtccctgagactgtcctgtgaagcgtctggattcactttcgctgactatcccatgcactgggtccgccaggctccaggcaaggggctggagtgggtggcagttatatcaagtcatggaagaagtcagggctacgcagcctccgtgaagggccgattcaccttctccagagacaattcccagagtagtctgtttctgcaattgaacagcctgagagttgaagacacggctgtgtatttctgtgcgagagaggcgcagagcagtggtcgggccggatgccttgacgcctggggccagggaaccctggtcaccgtctcctca

SEQ ID NO: 17711 - skipped

SEQ ID NO: 17712 - protein, 107 aa, Artificial Sequence
  Description of Artificial Sequence: Synthetic polypeptide
DIRLTQSPSSLSASVGDRVTITCRASQAIAGWLAWYQQKPGRAPKSLIYRASSLQSGVPSRFSGSGSGTDFSLTISNLQPEDSATYYCQHYDSYPTAFGQGTRLEIK

SEQ ID NO: 17713 - protein, 23 aa, Artificial Sequence
  Description of Artificial Sequence: Synthetic peptide
DIRLTQSPSSLSASVGDRVTITC

SEQ ID NO: 17714 - protein, 11 aa, Artificial Sequence
  Description of Artificial Sequence: Synthetic peptide
RASQAIAGWLA

SEQ ID NO: 17715 - protein, 15 aa, Artificial Sequence
  Description of Artificial Sequence: Synthetic peptide
WYQQKPGRAPKSLIY

SEQ ID NO: 17716 - protein, 7 aa, Artificial Sequence
  Description of Artificial Sequence: Synthetic peptide
RASSLQS

SEQ ID NO: 17717 - protein, 32 aa, Artificial Sequence
  Description of Artificial Sequence: Synthetic polypeptide
GVPSRFSGSGSGTDFSLTISNLQPEDSATYYC

SEQ ID NO: 17718 - protein, 9 aa, Artificial Sequence
  Description of Artificial Sequence: Synthetic peptide
QHYDSYPTA

SEQ ID NO: 17719 - protein, 10 aa, Artificial Sequence
  Description of Artificial Sequence: Synthetic peptide
FGQGTRLEIK

SEQ ID NO: 17720 - DNA, 321 bp, Artificial Sequence
  Description of Artificial Sequence: Synthetic polynucleotide
gacatccggttgacccagtctccatcctcactgtctgcatctgtaggagacagagtcaccatcacttgtcgggcgagccaggctattgccggctggttagcctggtatcaacagaaaccagggcgagcccctaagtccctgatctatcgtgcgtccagcttgcagagtggggtcccatcaaggttcagcggcagtggatctgggacagatttcagtctcaccatcagcaacctgcagcctgaagattctgcaacttattactgccaacattatgactcttacccaaccgccttcggccaagggacacgactggagattaaa

SEQ ID NO: 17721-17801 - skipped (81 entries)

SEQ ID NO: 17802 - protein, 129 aa, Artificial Sequence
  Description of Artificial Sequence: Synthetic polypeptide
QVQLVQSGAEVREPGSSVKLSCKTSGGTFSTHAISWVRQAPGQRPEWMGGIMPIFGESKDTQKFQGRVTFTADESTTTAYMELRSLKSDDTAIYYCVRDSDPYTATVRSNHYWYAMDVWGQGTTVTVSS

SEQ ID NO: 17803 - protein, 26 aa, Artificial Sequence
  Description of Artificial Sequence: Synthetic peptide
QVQLVQSGAEVREPGSSVKLSCKTSG

SEQ ID NO: 17804 - protein, 9 aa, Artificial Sequence
  Description of Artificial Sequence: Synthetic peptide
GTFSTHAIS

SEQ ID NO: 17805 - protein, 14 aa, Artificial Sequence
  Description of Artificial Sequence: Synthetic peptide
WVRQAPGQRPEWMG

SEQ ID NO: 17806 - protein, 17 aa, Artificial Sequence
  Description of Artificial Sequence: Synthetic peptide
GIMPIFGESKDTQKFQG

SEQ ID NO: 17807 - protein, 30 aa, Artificial Sequence; identical to SEQ ID NO: 2507
  Description of Artificial Sequence: Synthetic polypeptide

SEQ ID NO: 17808 - protein, 22 aa, Artificial Sequence
  Description of Artificial Sequence: Synthetic peptide
VRDSDPYTATVRSNHYWYAMDV

SEQ ID NO: 17809 - protein, 11 aa, Artificial Sequence
  Description of Artificial Sequence: Synthetic peptide
WGQGTTVTVSS

SEQ ID NO: 17810 - DNA, 387 bp, Artificial Sequence
  Description of Artificial Sequence: Synthetic polynucleotide
caggtccagctggtgcagtctggggctgaggtgagggagcctgggtcctcggtgaagctctcctgcaagacttctggaggcaccttcagcactcatgcaatcagctgggtgcggcaggcccctggacaacggcctgagtggatgggagggatcatgcctatttttggtgagtcaaaagacacacagaagtttcaaggcagagtcacctttaccgcggacgaatccacgactacagcctacatggagttgaggagcctaaaatctgacgacacggccatatattattgtgtgagagactctgacccctacacggcgactgttaggagtaatcactattggtatgcaatggacgtctggggccaggggaccacggtcaccgtctcctca

SEQ ID NO: 17811 - skipped

SEQ ID NO: 17812 - protein, 112 aa, Artificial Sequence
  Description of Artificial Sequence: Synthetic polypeptide
ETTLTQSPLSLAVTLGQPASISCRSSLGLVHTNGNTYLNWFQQRPGQSPRRLIYRVSNRDSGVPDRFSGSGSVTDFTLTISRVEAEDIGVYYCMQGTEWPRTFGQGTKVEIK

SEQ ID NO: 17813 - protein, 23 aa, Artificial Sequence
  Description of Artificial Sequence: Synthetic peptide
ETTLTQSPLSLAVTLGQPASISC

SEQ ID NO: 17814 - protein, 16 aa, Artificial Sequence
  Description of Artificial Sequence: Synthetic peptide
RSSLGLVHTNGNTYLN

SEQ ID NO: 17815 - protein, 15 aa, Artificial Sequence
  Description of Artificial Sequence: Synthetic peptide
WFQQRPGQSPRRLIY

SEQ ID NO: 17816 - protein, 7 aa, Artificial Sequence
  Description of Artificial Sequence: Synthetic peptide
RVSNRDS

SEQ ID NO: 17817 - protein, 32 aa, Artificial Sequence
  Description of Artificial Sequence: Synthetic polypeptide
GVPDRFSGSGSVTDFTLTISRVEAEDIGVYYC

SEQ ID NO: 17818 - protein, 9 aa, Artificial Sequence
  Description of Artificial Sequence: Synthetic peptide
MQGTEWPRT

SEQ ID NO: 17819 - protein, 10 aa, Artificial Sequence
  Description of Artificial Sequence: Synthetic peptide
FGQGTKVEIK

SEQ ID NO: 17820 - DNA, 336 bp, Artificial Sequence
  Description of Artificial Sequence: Synthetic polynucleotide
gaaacgacactcacgcagtctccactctccctggccgtcacccttggacagccggcctccatctcctgcaggtctagtctaggcctcgtacacactaatggaaacacgtacttgaattggtttcaacagaggccaggccaatctccaaggcgcctcatttatagggtttctaaccgggactctggggtcccagacagattcagcggcagtgggtcagtcactgacttcacactgacaatcagcagggtggaggctgaggatattggagtttattactgcatgcaaggtacagagtggcctcggacttttggccaggggaccaaggtggaaatcaaa

SEQ ID NO: 17821-17901 - skipped (81 entries)

SEQ ID NO: 17902 - protein, 126 aa, Artificial Sequence; identical to SEQ ID NO: 3702
  Description of Artificial Sequence: Synthetic polypeptide

SEQ ID NO: 17903 - protein, 26 aa, Artificial Sequence
  Description of Artificial Sequence: Synthetic peptide
EVQLVQSGAEVKKPGSSVKVSCKVSG

SEQ ID NO: 17904 - protein, 9 aa, Artificial Sequence
  Description of Artificial Sequence: Synthetic peptide
GRFSDYAIS

SEQ ID NO: 17905 - protein, 14 aa, Artificial Sequence
  Description of Artificial Sequence: Synthetic peptide
WLRQAPVKGLEWMG

SEQ ID NO: 17906 - protein, 17 aa, Artificial Sequence
  Description of Artificial Sequence: Synthetic peptide
GIIPRLNRKGYSQDFQG

SEQ ID NO: 17907 - protein, 30 aa, Artificial Sequence; identical to SEQ ID NO: 3707
  Description of Artificial Sequence: Synthetic polypeptide

SEQ ID NO: 17908 - protein, 19 aa, Artificial Sequence
  Description of Artificial Sequence: Synthetic peptide
ARDPTFLNSGNHFWYAVDI

SEQ ID NO: 17909 - protein, 11 aa, Artificial Sequence
  Description of Artificial Sequence: Synthetic peptide
WGQGTTVTVSS

SEQ ID NO: 17910 - DNA, 378 bp, Artificial Sequence
  Description of Artificial Sequence: Synthetic polynucleotide
gaggtccagctggtgcagtctggggctgaagtgaagaagcctgggtcctcggtgaaggtctcctgtaaggtttccggagggagattcagtgattacgctatcagctggctgcgacaggcccccgtaaaaggactcgagtggatggggggaatcatccctcgtctaaatagaaaaggatactcacaggatttccagggcagactcacctttactgcggacgagtccaccagcaccgcctacatggaattgagtggcctgacgtctgaagacacggccgtttattactgtgcaagagatccgacttttcttaacagtggaaatcacttctggtatgctgttgatatctggggccaagggaccacggtcaccgtctcctca

SEQ ID NO: 17911 - skipped

SEQ ID NO: 17912 - protein, 112 aa, Artificial Sequence
  Description of Artificial Sequence: Synthetic polypeptide
ETTLTQSPLSLSVTLGQAASISCTCSQTAVHSDGNTYLNWFHQRPGQSPRRLIYKVSNRDSGVPDRFSGSGSGTDFTLKISRVEAEDVGIYYCMQTTDWPRTFGQGTKVDIK

SEQ ID NO: 17913 - protein, 23 aa, Artificial Sequence
  Description of Artificial Sequence: Synthetic peptide
ETTLTQSPLSLSVTLGQAASISC

SEQ ID NO: 17914 - protein, 16 aa, Artificial Sequence
  Description of Artificial Sequence: Synthetic peptide
TCSQTAVHSDGNTYLN

SEQ ID NO: 17915 - protein, 15 aa, Artificial Sequence
  Description of Artificial Sequence: Synthetic peptide
WFHQRPGQSPRRLIY

SEQ ID NO: 17916 - protein, 7 aa, Artificial Sequence
  Description of Artificial Sequence: Synthetic peptide
KVSNRDS

SEQ ID NO: 17917 - protein, 32 aa, Artificial Sequence; identical to SEQ ID NO: 1517
  Description of Artificial Sequence: Synthetic polypeptide

SEQ ID NO: 17918 - protein, 9 aa, Artificial Sequence
  Description of Artificial Sequence: Synthetic peptide
MQTTDWPRT

SEQ ID NO: 17919 - protein, 10 aa, Artificial Sequence
  Description of Artificial Sequence: Synthetic peptide
FGQGTKVDIK

SEQ ID NO: 17920 - DNA, 336 bp, Artificial Sequence
  Description of Artificial Sequence: Synthetic polynucleotide
gaaacgacactcacgcagtctccactctccctgtccgtcacccttggacaggcggcctccatctcctgcacctgtagtcaaacggccgtgcactctgatggaaacacctacctgaattggtttcaccagaggccaggccaatctccaaggcgcctcatttataaggtttctaatcgggactctggggtcccagacagattcagcggcagtgggtcaggcactgatttcacactgaaaatcagcagggtggaggctgaggatgttggaatttattactgcatgcaaactacagactggcctcggacgttcggccaagggaccaaagtggatatcaaa

SEQ ID NO: 17921-18001 - skipped (81 entries)

SEQ ID NO: 18002 - protein, 127 aa, Artificial Sequence
  Description of Artificial Sequence: Synthetic polypeptide
QVQLQESGRGLVKPSETLSLTCTVSGGSITSSRYYWGWIRQPPGRNLEWIGSIHYSGTTSYNPSLWSRVAISVDTAQNQFSLRLNSVTAADTAVYYCAAPAPSNHESWSGTDWFDPWGQGILVTVSS

SEQ ID NO: 18003 - protein, 26 aa, Artificial Sequence
  Description of Artificial Sequence: Synthetic peptide
QVQLQESGRGLVKPSETLSLTCTVSG

SEQ ID NO: 18004 - protein, 11 aa, Artificial Sequence
  Description of Artificial Sequence: Synthetic peptide
GSITSSRYYWG

SEQ ID NO: 18005 - protein, 14 aa, Artificial Sequence
  Description of Artificial Sequence: Synthetic peptide
WIRQPPGRNLEWIG

SEQ ID NO: 18006 - protein, 16 aa, Artificial Sequence
  Description of Artificial Sequence: Synthetic peptide
SIHYSGTTSYNPSLWS

SEQ ID NO: 18007 - protein, 30 aa, Artificial Sequence
  Description of Artificial Sequence: Synthetic polypeptide
RVAISVDTAQNQFSLRLNSVTAADTAVYYC

SEQ ID NO: 18008 - protein, 19 aa, Artificial Sequence
  Description of Artificial Sequence: Synthetic peptide
AAPAPSNHESWSGTDWFDP

SEQ ID NO: 18009 - protein, 11 aa, Artificial Sequence
  Description of Artificial Sequence: Synthetic peptide
WGQGILVTVSS

SEQ ID NO: 18010 - DNA, 381 bp, Artificial Sequence
  Description of Artificial Sequence: Synthetic polynucleotide
caggtgcagctgcaggagtcgggccgaggactggtgaagccctcggagaccctgtccctcacctgcactgtctctggtggctcaatcaccagtagtcgttactactggggctggatccgccagccccccgggaggaacctggagtggattggaagtatacattatagtgggaccacctcctacaacccgtccctgtggagtcgagtcgccatatccgtagacacggcccagaaccagttctccctgaggctgaactcagtcaccgccgcagacacggctgtgtattactgtgcagcccctgcgccttcaaatcacgaatcttggagtgggacagattggttcgacccctggggccagggaattctggtcaccgtctcttca

SEQ ID NO: 18011 - skipped

SEQ ID NO: 18012 - protein, 107 aa, Artificial Sequence
  Description of Artificial Sequence: Synthetic polypeptide
EIVMTQSPASLSASVGDRVTITCRAGQSISTNLCWYQQRQGKAPKLLIYAASSLRSGVPSRFSGSGSGTDFTLTISSLQPEDFATYYCQQSYSTPPTFGGGTKVDIK

SEQ ID NO: 18013 - protein, 23 aa, Artificial Sequence
  Description of Artificial Sequence: Synthetic peptide
EIVMTQSPASLSASVGDRVTITC

SEQ ID NO: 18014 - protein, 11 aa, Artificial Sequence
  Description of Artificial Sequence: Synthetic peptide
RAGQSISTNLC

SEQ ID NO: 18015 - protein, 15 aa, Artificial Sequence
  Description of Artificial Sequence: Synthetic peptide
WYQQRQGKAPKLLIY

SEQ ID NO: 18016 - protein, 7 aa, Artificial Sequence
  Description of Artificial Sequence: Synthetic peptide
AASSLRS

SEQ ID NO: 18017 - protein, 32 aa, Artificial Sequence; identical to SEQ ID NO: 517
  Description of Artificial Sequence: Synthetic polypeptide

SEQ ID NO: 18018 - protein, 9 aa, Artificial Sequence
  Description of Artificial Sequence: Synthetic peptide
QQSYSTPPT

SEQ ID NO: 18019 - protein, 10 aa, Artificial Sequence
  Description of Artificial Sequence: Synthetic peptide
FGGGTKVDIK

SEQ ID NO: 18020 - DNA, 321 bp, Artificial Sequence
  Description of Artificial Sequence: Synthetic polynucleotide
gaaattgtgatgacacagtctccagcctccctgtctgcatctgttggagacagagtcaccatcacttgccgggcaggtcagagcattagcaccaacttgtgttggtatcaacaaagacaggggaaagcccctaagctcctgatctatgctgcatccagtttgcggagtggagtcccatccaggttcagtggcagcggctctgggacagatttcactctcaccatcagcagtctgcaacctgaagattttgcaacttactactgtcaacagagttacagtacccctcccactttcggcggagggaccaaagtggatatcaaa

SEQ ID NO: 18021-18101 - skipped (81 entries)

SEQ ID NO: 18102 - protein, 123 aa, Artificial Sequence
  Description of Artificial Sequence: Synthetic polypeptide
QVQLVQSGAEVKGPGASVKVSCKVSGYSFITYDITWVRQAPGQGLEWMGWISTKSGDTRYAQNVQGRVTMTTDTSTNTAYMELRNLKSDDTALYYCARTTPRGWEQWPVLEYWGQGTLVTVSS

SEQ ID NO: 18103 - protein, 26 aa, Artificial Sequence
  Description of Artificial Sequence: Synthetic peptide
QVQLVQSGAEVKGPGASVKVSCKVSG

SEQ ID NO: 18104 - protein, 9 aa, Artificial Sequence
  Description of Artificial Sequence: Synthetic peptide
YSFITYDIT

SEQ ID NO: 18105 - protein, 14 aa, Artificial Sequence
  Description of Artificial Sequence: Synthetic peptide
WVRQAPGQGLEWMG

SEQ ID NO: 18106 - protein, 17 aa, Artificial Sequence
  Description of Artificial Sequence: Synthetic peptide
WISTKSGDTRYAQNVQG

SEQ ID NO: 18107 - protein, 30 aa, Artificial Sequence
  Description of Artificial Sequence: Synthetic polypeptide
RVTMTTDTSTNTAYMELRNLKSDDTALYYC

SEQ ID NO: 18108 - protein, 16 aa, Artificial Sequence
  Description of Artificial Sequence: Synthetic peptide
ARTTPRGWEQWPVLEY

SEQ ID NO: 18109 - protein, 11 aa, Artificial Sequence
  Description of Artificial Sequence: Synthetic peptide
WGQGTLVTVSS

SEQ ID NO: 18110 - DNA, 369 bp, Artificial Sequence
  Description of Artificial Sequence: Synthetic polynucleotide
caggtccagcttgtgcagtctggagctgaggtgaaggggcccggggcctcagtgaaggtctcctgcaaggtttctggttacagctttatcacttatgacatcacctgggtgcgacaggcccctggacaagggcttgagtggatgggatggatcagcactaagagtggtgacacaaggtatgcacagaacgtccagggcagagtcaccatgaccacagacacgtcgacgaatacagcctacatggagctgaggaacttgaaatctgacgacacggccctatattactgtgcgagaacgaccccgagagggtgggagcagtggcccgttctagaatactggggccagggaaccctggtcaccgtctcttca

SEQ ID NO: 18111 - skipped

SEQ ID NO: 18112 - protein, 108 aa, Artificial Sequence
  Description of Artificial Sequence: Synthetic polypeptide
DIQVTQSPATLSVSPGERVTLSCRASQSISNTLAWYQQKPGQAPRLLIYGASTRATGIPARFSGSGSGTEFTLTISSLQSEDFAVYYCHQYNKWPPITFGGGTKVEIK

SEQ ID NO: 18113 - protein, 23 aa, Artificial Sequence
  Description of Artificial Sequence: Synthetic peptide
DIQVTQSPATLSVSPGERVTLSC

SEQ ID NO: 18114 - protein, 11 aa, Artificial Sequence
  Description of Artificial Sequence: Synthetic peptide
RASQSISNTLA

SEQ ID NO: 18115 - protein, 15 aa, Artificial Sequence
  Description of Artificial Sequence: Synthetic peptide
WYQQKPGQAPRLLIY

SEQ ID NO: 18116 - protein, 7 aa, Artificial Sequence
  Description of Artificial Sequence: Synthetic peptide
GASTRAT

SEQ ID NO: 18117 - protein, 32 aa, Artificial Sequence; identical to SEQ ID NO: 13917
  Description of Artificial Sequence: Synthetic polypeptide

SEQ ID NO: 18118 - protein, 10 aa, Artificial Sequence
  Description of Artificial Sequence: Synthetic peptide
HQYNKWPPIT

SEQ ID NO: 18119 - protein, 10 aa, Artificial Sequence
  Description of Artificial Sequence: Synthetic peptide
FGGGTKVEIK

SEQ ID NO: 18120 - DNA, 324 bp, Artificial Sequence
  Description of Artificial Sequence: Synthetic polynucleotide
gacatccaggtgacccagtctcccgccaccctgtctgtgtctccgggggaaagagtcaccctctcctgcagggccagtcagagtattagcaacaccttagcctggtatcaacagaaacctggccaggctcccaggctcctcatctatggtgcgtccaccagggccactggtatcccagccaggttcagtggcagtgggtctgggacagagttcactctcaccatcagcagcctgcagtctgaagattttgcagtttattattgtcaccagtataataagtggcctccgatcactttcggcggagggaccaaggtggaaatcaaa

SEQ ID NO: 18121-18201 - skipped (81 entries)

SEQ ID NO: 18202 - protein, 124 aa, Artificial Sequence
  Description of Artificial Sequence: Synthetic polypeptide
EVQLVESGGGLVQPGGSLRLSCEASGFNFNSYSMSWVRQAPGKGLEWLSYISSRSSTIKYASSVQGRFTVSRDNAKKSVYLQMNSLRDEDTAVYFCARELDSETYYNYNSLDVWGQGTTVTVSS

SEQ ID NO: 18203 - protein, 26 aa, Artificial Sequence
  Description of Artificial Sequence: Synthetic peptide
EVQLVESGGGLVQPGGSLRLSCEASG

SEQ ID NO: 18204 - protein, 9 aa, Artificial Sequence
  Description of Artificial Sequence: Synthetic peptide
FNFNSYSMS

SEQ ID NO: 18205 - protein, 14 aa, Artificial Sequence
  Description of Artificial Sequence: Synthetic peptide
WVRQAPGKGLEWLS

SEQ ID NO: 18206 - protein, 17 aa, Artificial Sequence
  Description of Artificial Sequence: Synthetic peptide
YISSRSSTIKYASSVQG

SEQ ID NO: 18207 - protein, 30 aa, Artificial Sequence
  Description of Artificial Sequence: Synthetic polypeptide
RFTVSRDNAKKSVYLQMNSLRDEDTAVYFC

SEQ ID NO: 18208 - protein, 17 aa, Artificial Sequence
  Description of Artificial Sequence: Synthetic peptide
ARELDSETYYNYNSLDV

SEQ ID NO: 18209 - protein, 11 aa, Artificial Sequence
  Description of Artificial Sequence: Synthetic peptide
WGQGTTVTVSS

SEQ ID NO: 18210 - DNA, 372 bp, Artificial Sequence
  Description of Artificial Sequence: Synthetic polynucleotide
gaggtgcagctggtggagtctgggggaggcttggttcagccgggggggtccctgagactctcctgtgaagcctctggattcaacttcaatagttacagtatgagctgggtccgccaggctccagggaaggggctggagtggctctcatacataagtagtcgtagttccacaattaagtatgcaagctctgtgcagggccgcttcaccgtctcccgagacaatgcaaagaagtcagtgtatctgcaaatgaacagcctgagagacgaggacacggctgtctatttctgtgcgagagaattggattctgagacttactacaattacaactccttggacgtctggggccagggcaccacggtcaccgtctcttca

SEQ ID NO: 18211 - skipped

SEQ ID NO: 18212 - protein, 107 aa, Artificial Sequence
  Description of Artificial Sequence: Synthetic polypeptide
DIQMTQSPSSLSASVGDRVTISCRASQGISTFLAWFQQRPGKAPKSLIYAASKLQSGVPSRFSGSDSGPDFTLTIDNLRPEDSATYYCKQYNSYPYTFGQGTKLEIK

SEQ ID NO: 18213 - protein, 23 aa, Artificial Sequence
  Description of Artificial Sequence: Synthetic peptide
DIQMTQSPSSLSASVGDRVTISC

SEQ ID NO: 18214 - protein, 11 aa, Artificial Sequence
  Description of Artificial Sequence: Synthetic peptide
RASQGISTFLA

SEQ ID NO: 18215 - protein, 15 aa, Artificial Sequence
  Description of Artificial Sequence: Synthetic peptide
WFQQRPGKAPKSLIY

SEQ ID NO: 18216 - protein, 7 aa, Artificial Sequence
  Description of Artificial Sequence: Synthetic peptide
AASKLQS

SEQ ID NO: 18217 - protein, 32 aa, Artificial Sequence
  Description of Artificial Sequence: Synthetic polypeptide
GVPSRFSGSDSGPDFTLTIDNLRPEDSATYYC

SEQ ID NO: 18218 - protein, 9 aa, Artificial Sequence
  Description of Artificial Sequence: Synthetic peptide
KQYNSYPYT

SEQ ID NO: 18219 - protein, 10 aa, Artificial Sequence
  Description of Artificial Sequence: Synthetic peptide
FGQGTKLEIK

SEQ ID NO: 18220 - DNA, 321 bp, Artificial Sequence
  Description of Artificial Sequence: Synthetic polynucleotide
gacatccagatgacccagtctccatcctcactgtctgcatctgtgggagacagagtcaccatctcttgtcgggcgagtcagggcattagcacttttttagcctggtttcaacagagaccagggaaagcccctaagtccctgatctatgctgcatccaagttgcaaagtggggtcccatcaagattcagcggcagtgattctgggccagatttcactctcaccatcgacaacctgcggcctgaagattctgccacttattactgcaagcagtataatagttatccgtacacttttggccaggggaccaagctggagatcaaa

SEQ ID NO: 18221-18301 - skipped (81 entries)

SEQ ID NO: 18302 - protein, 128 aa, Artificial Sequence
  Description of Artificial Sequence: Synthetic polypeptide
QVQLVESGGEVKKPGASVKVSCKASGYTLSSYPISWVRQAPGHGLEWMGWINTYNGRTNYEQMLQGRVTMTTDTSTSTAYMELRSLRSDDTAVYYCARVVFRHGQYDDSSGRLAFDIWGQGTMVTVSS

SEQ ID NO: 18303 - protein, 26 aa, Artificial Sequence
  Description of Artificial Sequence: Synthetic peptide
QVQLVESGGEVKKPGASVKVSCKASG

SEQ ID NO: 18304 - protein, 9 aa, Artificial Sequence
  Description of Artificial Sequence: Synthetic peptide
YTLSSYPIS

SEQ ID NO: 18305 - protein, 14 aa, Artificial Sequence
  Description of Artificial Sequence: Synthetic peptide
WVRQAPGHGLEWMG

SEQ ID NO: 18306 - protein, 17 aa, Artificial Sequence
  Description of Artificial Sequence: Synthetic peptide
WINTYNGRTNYEQMLQG

SEQ ID NO: 18307 - protein, 30 aa, Artificial Sequence
  Description of Artificial Sequence: Synthetic polypeptide
RVTMTTDTSTSTAYMELRSLRSDDTAVYYC

SEQ ID NO: 18308 - protein, 21 aa, Artificial Sequence
  Description of Artificial Sequence: Synthetic peptide
ARVVFRHGQYDDSSGRLAFDI

SEQ ID NO: 18309 - protein, 11 aa, Artificial Sequence
  Description of Artificial Sequence: Synthetic peptide
WGQGTMVTVSS

SEQ ID NO: 18310 - DNA, 384 bp, Artificial Sequence
  Description of Artificial Sequence: Synthetic polynucleotide
caggtgcagctggtggagtctggaggtgaagtgaagaagcctggggcctcagtgaaggtctcctgcaaggcttctggctacaccttaagcagctaccctattagctgggtgcgacaggcccctggacacgggcttgagtggatgggatggatcaacacttataatggtaggactaattatgaacagatgctccagggcagagtcaccatgaccacagacacatctacgagcacagcctacatggagctgaggagtctgagatctgacgacacggccgtgtattactgtgcgagagtggtttttcgccacggtcaatacgatgatagtagcggccgccttgcttttgatatctggggccaagggacaatggtcactgtctcctca

SEQ ID NO: 18311 - skipped

SEQ ID NO: 18312 - protein, 107 aa, Artificial Sequence
  Description of Artificial Sequence: Synthetic polypeptide
EIVMTQSPSSLSASVGDSVTITCRASQSISNYLNWYQDKPGKAPELLIYAASNLQSGVPSRFSGSGSGTDFTLTISSLQPEDFATYYCQQSYSDSWTFGQGTKVDIK

SEQ ID NO: 18313 - protein, 23 aa, Artificial Sequence
  Description of Artificial Sequence: Synthetic peptide
EIVMTQSPSSLSASVGDSVTITC

SEQ ID NO: 18314 - protein, 11 aa, Artificial Sequence
  Description of Artificial Sequence: Synthetic peptide
RASQSISNYLN

SEQ ID NO: 18315 - protein, 15 aa, Artificial Sequence
  Description of Artificial Sequence: Synthetic peptide
WYQDKPGKAPELLIY

SEQ ID NO: 18316 - protein, 7 aa, Artificial Sequence
  Description of Artificial Sequence: Synthetic peptide
AASNLQS

SEQ ID NO: 18317 - protein, 32 aa, Artificial Sequence; identical to SEQ ID NO: 517
  Description of Artificial Sequence: Synthetic polypeptide

SEQ ID NO: 18318 - protein, 9 aa, Artificial Sequence
  Description of Artificial Sequence: Synthetic peptide
QQSYSDSWT

SEQ ID NO: 18319 - protein, 10 aa, Artificial Sequence
  Description of Artificial Sequence: Synthetic peptide
FGQGTKVDIK

SEQ ID NO: 18320 - DNA, 321 bp, Artificial Sequence
  Description of Artificial Sequence: Synthetic polynucleotide
gaaattgtaatgacgcagtctccatcctccctgtctgcatctgtaggagacagtgtcaccatcacttgccgggcaagtcaaagcattagtaactatttaaattggtatcaggataaaccagggaaagcccctgagctcctgatctatgctgcatccaatttgcaaagtggggtcccatcaagattcagtggcagtggatctgggacagatttcactctcaccatcagcagtctgcaacctgaagactttgcaacttactactgtcaacagagttacagtgactcgtggacgttcggccaagggaccaaagtggatatcaaa

SEQ ID NO: 18321-18401 - skipped (81 entries)

SEQ ID NO: 18402 - protein, 126 aa, Artificial Sequence; identical to SEQ ID NO: 1702
  Description of Artificial Sequence: Synthetic polypeptide

SEQ ID NO: 18403 - protein, 26 aa, Artificial Sequence
  Description of Artificial Sequence: Synthetic peptide
QVQLVQSGAELKKPGSSVRVSCKAAG

SEQ ID NO: 18404 - protein, 9 aa, Artificial Sequence
  Description of Artificial Sequence: Synthetic peptide
GTLTNYAIS

SEQ ID NO: 18405 - protein, 14 aa, Artificial Sequence
  Description of Artificial Sequence: Synthetic peptide
WVRQAPGQGFEWMG

SEQ ID NO: 18406 - protein, 17 aa, Artificial Sequence
  Description of Artificial Sequence: Synthetic peptide
GIMPVSHTAGYAQKFQG

SEQ ID NO: 18407 - protein, 30 aa, Artificial Sequence; identical to SEQ ID NO: 1507
  Description of Artificial Sequence: Synthetic polypeptide

SEQ ID NO: 18408 - protein, 19 aa, Artificial Sequence
  Description of Artificial Sequence: Synthetic peptide
ARDPSIHYTGNHHWYDLDI

SEQ ID NO: 18409 - protein, 11 aa, Artificial Sequence
  Description of Artificial Sequence: Synthetic peptide
WGQGTMVTVSS

SEQ ID NO: 18410 - DNA, 378 bp, Artificial Sequence
  Description of Artificial Sequence: Synthetic polynucleotide
caggtccagctggtacagtctggggctgagttgaagaagcctgggtcgtcggtgagggtctcctgcaaggcggctggaggcaccctcactaattatgccataagttgggtgcgacaggcccctggacaagggtttgagtggatgggagggatcatgcctgtctctcatacggcaggctacgcacagaaatttcagggccgagtcacctttaccgcggacgaatccgcgaccacagcctacatggacctaacgagcctgagacctgaggacacggccatatattactgtgccagagatccgtctattcattacactgggaatcaccattggtatgatttagatatctggggccaagggacaatggtcaccgtctcctca

SEQ ID NO: 18411 - skipped

SEQ ID NO: 18412 - protein, 112 aa, Artificial Sequence
  Description of Artificial Sequence: Synthetic polypeptide
ETTLTQSPLSLPVTLGQPASISCRSSQRIVHTDGNTYLNWFLQRPGQSPRRLIYKVSNRDSGVPDRFSGSGSGTDFTLKISRVEAEDVGIYYCMQGTEWPRTFGQGTKVEIK

SEQ ID NO: 18413 - protein, 23 aa, Artificial Sequence
  Description of Artificial Sequence: Synthetic peptide
ETTLTQSPLSLPVTLGQPASISC

SEQ ID NO: 18414 - protein, 16 aa, Artificial Sequence
  Description of Artificial Sequence: Synthetic peptide
RSSQRIVHTDGNTYLN

SEQ ID NO: 18415 - protein, 15 aa, Artificial Sequence
  Description of Artificial Sequence: Synthetic peptide
WFLQRPGQSPRRLIY

SEQ ID NO: 18416 - protein, 7 aa, Artificial Sequence
  Description of Artificial Sequence: Synthetic peptide
KVSNRDS

SEQ ID NO: 18417 - protein, 32 aa, Artificial Sequence; identical to SEQ ID NO: 1517
  Description of Artificial Sequence: Synthetic polypeptide

SEQ ID NO: 18418 - protein, 9 aa, Artificial Sequence
  Description of Artificial Sequence: Synthetic peptide
MQGTEWPRT

SEQ ID NO: 18419 - protein, 10 aa, Artificial Sequence
  Description of Artificial Sequence: Synthetic peptide
FGQGTKVEIK

SEQ ID NO: 18420 - DNA, 336 bp, Artificial Sequence
  Description of Artificial Sequence: Synthetic polynucleotide
gaaacgacactcacgcagtctccactctccctgcccgtcacccttggccagccggcctccatctcctgcaggtctagtcaaagaatcgtccacactgatggaaacacctacttgaattggtttctgcagaggccaggccaatctccaaggcgcctaatttataaggtctctaaccgggactccggggtcccagacagattcagcggcagtgggtcaggcactgatttcacactgaaaatcagcagggtggaggctgaggatgttggaatttattactgcatgcaaggtacagagtggcctcggacgttcggccaagggaccaaggtggagatcaaa

SEQ ID NO: 18421-18501 - skipped (81 entries)

SEQ ID NO: 18502 - protein, 129 aa, Artificial Sequence
  Description of Artificial Sequence: Synthetic polypeptide
EVQLLESGAEVKKPGSSVKVSCKTSGGTFSTHAISWVRQAPGQGPEWMGGIIPLFGTSEHAQRFQARVKFTADESTSTAYMELSSLTPEDTAVYYCVRDSDPYTATSRNNHYWYGMDVWGQGTTVTVSS

SEQ ID NO: 18503 - protein, 26 aa, Artificial Sequence
  Description of Artificial Sequence: Synthetic peptide
EVQLLESGAEVKKPGSSVKVSCKTSG

SEQ ID NO: 18504 - protein, 9 aa, Artificial Sequence
  Description of Artificial Sequence: Synthetic peptide
GTFSTHAIS

SEQ ID NO: 18505 - protein, 14 aa, Artificial Sequence
  Description of Artificial Sequence: Synthetic peptide
WVRQAPGQGPEWMG

SEQ ID NO: 18506 - protein, 17 aa, Artificial Sequence
  Description of Artificial Sequence: Synthetic peptide
GIIPLFGTSEHAQRFQA

SEQ ID NO: 18507 - protein, 30 aa, Artificial Sequence
  Description of Artificial Sequence: Synthetic polypeptide
RVKFTADESTSTAYMELSSLTPEDTAVYYC

SEQ ID NO: 18508 - protein, 22 aa, Artificial Sequence
  Description of Artificial Sequence: Synthetic peptide
VRDSDPYTATSRNNHYWYGMDV

SEQ ID NO: 18509 - protein, 11 aa, Artificial Sequence
  Description of Artificial Sequence: Synthetic peptide
WGQGTTVTVSS

SEQ ID NO: 18510 - DNA, 387 bp, Artificial Sequence
  Description of Artificial Sequence: Synthetic polynucleotide
gaggtgcagctgttggagtctggggctgaggtgaagaagcctgggtcctcggtgaaggtctcctgcaagacttctggaggcaccttcagcacccatgctatcagctgggtgcgacaggcccctggacaagggcctgagtggatgggagggatcatccctctttttggtacgtcagaacacgcacagaggttccaggccagagtcaagtttaccgcggacgagtccacgagcacagcctacatggagctgagcagcctgacacctgaagacacggccgtgtattattgtgtgagagactctgacccctatacggcgactagcaggaataatcactactggtatggtatggacgtctggggccaagggaccacggtcaccgtctcctca

SEQ ID NO: 18511 - skipped

SEQ ID NO: 18512 - protein, 112 aa, Artificial Sequence
  Description of Artificial Sequence: Synthetic polypeptide
DIQMTQSPLSLPVTLGQPASISCRSSQSVVHSDGNTYLNWFHQRPGQSPRRLIYKVSNRDSGVPDRFSGSGSGTDFTLKISRVEAEDIGVYYCMQGTDWPRTFGQGTKVDIK

SEQ ID NO: 18513 - protein, 23 aa, Artificial Sequence
  Description of Artificial Sequence: Synthetic peptide
DIQMTQSPLSLPVTLGQPASISC

SEQ ID NO: 18514 - protein, 16 aa, Artificial Sequence
  Description of Artificial Sequence: Synthetic peptide
RSSQSVVHSDGNTYLN

SEQ ID NO: 18515 - protein, 15 aa, Artificial Sequence
  Description of Artificial Sequence: Synthetic peptide
WFHQRPGQSPRRLIY

SEQ ID NO: 18516 - protein, 7 aa, Artificial Sequence
  Description of Artificial Sequence: Synthetic peptide
KVSNRDS

SEQ ID NO: 18517 - protein, 32 aa, Artificial Sequence; identical to SEQ ID NO: 1317
  Description of Artificial Sequence: Synthetic polypeptide

SEQ ID NO: 18518 - protein, 9 aa, Artificial Sequence
  Description of Artificial Sequence: Synthetic peptide
MQGTDWPRT

SEQ ID NO: 18519 - protein, 10 aa, Artificial Sequence
  Description of Artificial Sequence: Synthetic peptide
FGQGTKVDIK

SEQ ID NO: 18520 - DNA, 336 bp, Artificial Sequence
  Description of Artificial Sequence: Synthetic polynucleotide
gacatccagatgacccagtctccactctccctgcccgtcacccttggacagccggcctccatctcctgcaggtctagtcaaagcgtcgtacacagtgatggaaacacctacttgaattggtttcaccagaggccaggccaatctccaaggcgcctaatttataaggtttctaatcgggactctggggtcccagacagattcagcggcagtgggtcaggcactgacttcacactgaaaatcagcagggtggaggctgaggatattggagtttattactgcatgcaaggtacagactggcctcggacttttggccaggggaccaaagtggatatcaaa

SEQ ID NO: 18521-18601 - skipped (81 entries)

SEQ ID NO: 18602 - protein, 122 aa, Artificial Sequence
  Description of Artificial Sequence: Synthetic polypeptide
EVQLLESGGGVVQPGTSLRLSCAVSGFMFKNYAIHWVRQAPGKGLEWVAVISFDGSDISYTESVQGRFTISRDNSENMLYLQMNSLRAEDTAMYYCAREPDGIGAAGISGYWGQGTLVTVSS

SEQ ID NO: 18603 - protein, 26 aa, Artificial Sequence
  Description of Artificial Sequence: Synthetic peptide
EVQLLESGGGVVQPGTSLRLSCAVSG

SEQ ID NO: 18604 - protein, 9 aa, Artificial Sequence
  Description of Artificial Sequence: Synthetic peptide
FMFKNYAIH

SEQ ID NO: 18605 - protein, 14 aa, Artificial Sequence
  Description of Artificial Sequence: Synthetic peptide
WVRQAPGKGLEWVA

SEQ ID NO: 18606 - protein, 17 aa, Artificial Sequence
  Description of Artificial Sequence: Synthetic peptide
VISFDGSDISYTESVQG

SEQ ID NO: 18607 - protein, 30 aa, Artificial Sequence
  Description of Artificial Sequence: Synthetic polypeptide
RFTISRDNSENMLYLQMNSLRAEDTAMYYC

SEQ ID NO: 18608 - protein, 15 aa, Artificial Sequence
  Description of Artificial Sequence: Synthetic peptide
AREPDGIGAAGISGY

SEQ ID NO: 18609 - protein, 11 aa, Artificial Sequence
  Description of Artificial Sequence: Synthetic peptide
WGQGTLVTVSS

SEQ ID NO: 18610 - DNA, 366 bp, Artificial Sequence
  Description of Artificial Sequence: Synthetic polynucleotide
gaggtgcagctgttggagtctggggggggcgtggtccagcctgggacgtccctgagactctcctgtgcagtctctggattcatgttcaagaactatgctatccactgggtccgccaggctccaggcaaggggctggagtgggtggcagtcatctcatttgatggaagtgatataagttatacagagtccgtgcagggccgattcaccatctccagagacaattccgagaacatgttgtatctgcaaatgaacagcctgagagcggaggacacggctatgtattactgtgcgagagagcccgacggtataggagcggccggtataagtggctattggggccagggaaccctggtcaccgtctcttca

SEQ ID NO: 18611 - skipped

SEQ ID NO: 18612 - protein, 113 aa, Artificial Sequence
  Description of Artificial Sequence: Synthetic polypeptide
GIVLTQSPDSLAVSVGERATINCKSSQTVLYSSKNKHYLAWYQQKPGQPPKLLTSSPSTREPGVPDRFSGSGSGTDFTLTISSLQAEDVAVYYCQQYYTTPYTFGQGTKVDIK

SEQ ID NO: 18613 - protein, 23 aa, Artificial Sequence
  Description of Artificial Sequence: Synthetic peptide
GIVLTQSPDSLAVSVGERATINC

SEQ ID NO: 18614 - protein, 17 aa, Artificial Sequence
  Description of Artificial Sequence: Synthetic peptide
KSSQTVLYSSKNKHYLA

SEQ ID NO: 18615 - protein, 15 aa, Artificial Sequence
  Description of Artificial Sequence: Synthetic peptide
WYQQKPGQPPKLLTS

SEQ ID NO: 18616 - protein, 7 aa, Artificial Sequence
  Description of Artificial Sequence: Synthetic peptide
SPSTREP

SEQ ID NO: 18617 - protein, 32 aa, Artificial Sequence; identical to SEQ ID NO: 1617
  Description of Artificial Sequence: Synthetic polypeptide

SEQ ID NO: 18618 - protein, 9 aa, Artificial Sequence
  Description of Artificial Sequence: Synthetic peptide
QQYYTTPYT

SEQ ID NO: 18619 - protein, 10 aa, Artificial Sequence
  Description of Artificial Sequence: Synthetic peptide
FGQGTKVDIK

SEQ ID NO: 18620 - DNA, 339 bp, Artificial Sequence
  Description of Artificial Sequence: Synthetic polynucleotide
ggtattgtgctgacgcagtctccagactccctggctgtgtctgtgggcgagagggccaccatcaactgcaagtccagccagactgttttatacagttccaaaaataaacattatttagcttggtaccagcagaaaccaggacagcctcctaaactgctcacttcctcgccatctacccgggaacccggggtccctgaccggttcagtggcagcgggtctgggacagatttcactctcaccatcagcagcctgcaggctgaagatgtggcagtttattactgtcaacaatattatactactccgtacacttttggccaggggaccaaagtggatatcaaa

SEQ ID NO: 18621-18701 - skipped (81 entries)

SEQ ID NO: 18702 - protein, 123 aa, Artificial Sequence
  Description of Artificial Sequence: Synthetic polypeptide
EVQLVESGGGLVKPGGSLRLSCVASGFTFSDFYMSWIRQAPGKGLEWVSYISGSGDTIYYADSVKGRFTVSRDNAKNSLFLQMSSLGAEDTAMYYCAREMATSFGYYFVLDVWGQGTTVTVSS

SEQ ID NO: 18703 - protein, 26 aa, Artificial Sequence
  Description of Artificial Sequence: Synthetic peptide
EVQLVESGGGLVKPGGSLRLSCVASG

SEQ ID NO: 18704 - protein, 9 aa, Artificial Sequence
  Description of Artificial Sequence: Synthetic peptide
FTFSDFYMS

SEQ ID NO: 18705 - protein, 14 aa, Artificial Sequence
  Description of Artificial Sequence: Synthetic peptide
WIRQAPGKGLEWVS

SEQ ID NO: 18706 - protein, 17 aa, Artificial Sequence
  Description of Artificial Sequence: Synthetic peptide
YISGSGDTIYYADSVKG

SEQ ID NO: 18707 - protein, 30 aa, Artificial Sequence
  Description of Artificial Sequence: Synthetic polypeptide
RFTVSRDNAKNSLFLQMSSLGAEDTAMYYC

SEQ ID NO: 18708 - protein, 16 aa, Artificial Sequence
  Description of Artificial Sequence: Synthetic peptide
AREMATSFGYYFVLDV

SEQ ID NO: 18709 - protein, 11 aa, Artificial Sequence
  Description of Artificial Sequence: Synthetic peptide
WGQGTTVTVSS

SEQ ID NO: 18710 - DNA, 369 bp, Artificial Sequence
  Description of Artificial Sequence: Synthetic polynucleotide
gaggtgcagctggtggagtctgggggaggcttggtcaagcctggagggtccctgagactctcctgtgtagcctctggattcaccttcagtgacttctacatgagctggatccgccaggctccagggaaggggctggagtgggtttcatacattagtggtagtggtgataccatatactacgcagactctgtgaagggccgattcaccgtctccagagacaatgccaagaactcactgtttctgcaaatgagcagcctgggagccgaggacacggccatgtattactgtgcgagagagatggcaacaagtttcggctactacttcgttttggacgtctggggccaagggaccacggtcaccgtctcctca

SEQ ID NO: 18711 - skipped

SEQ ID NO: 18712 - protein, 110 aa, Artificial Sequence
  Description of Artificial Sequence: Synthetic polypeptide
EIVMTQTPSSLSASVGDRVTITCRASQSISNYVNWYQQKPGRAPNLLIYAASSLQSGVSSRFSGSGSGTDFTLTISSLQPEDFATYYCQQTYSTPPEGPTFGPGTKVEIK

SEQ ID NO: 18713 - protein, 23 aa, Artificial Sequence
  Description of Artificial Sequence: Synthetic peptide
EIVMTQTPSSLSASVGDRVTITC

SEQ ID NO: 18714 - protein, 11 aa, Artificial Sequence
  Description of Artificial Sequence: Synthetic peptide
RASQSISNYVN

SEQ ID NO: 18715 - protein, 15 aa, Artificial Sequence
  Description of Artificial Sequence: Synthetic peptide
WYQQKPGRAPNLLIY

SEQ ID NO: 18716 - protein, 7 aa, Artificial Sequence
  Description of Artificial Sequence: Synthetic peptide
AASSLQS

SEQ ID NO: 18717 - protein, 32 aa, Artificial Sequence
  Description of Artificial Sequence: Synthetic polypeptide
GVSSRFSGSGSGTDFTLTISSLQPEDFATYYC

SEQ ID NO: 18718 - protein, 12 aa, Artificial Sequence
  Description of Artificial Sequence: Synthetic peptide
QQTYSTPPEGPT

SEQ ID NO: 18719 - protein, 10 aa, Artificial Sequence
  Description of Artificial Sequence: Synthetic peptide
FGPGTKVEIK

SEQ ID NO: 18720 - DNA, 330 bp, Artificial Sequence
  Description of Artificial Sequence: Synthetic polynucleotide
gaaattgtgatgacacagactccatcctccctgtctgcatctgtaggagacagagtcaccatcacttgccgggcaagtcagagtattagtaattatgtaaattggtatcagcagaaaccagggagagcccctaacctcctgatctatgctgcatccagtttgcaaagtggggtctcgtcaaggttcagtggcagtggatctgggacagatttcactctcaccatcagcagtctgcaacctgaagattttgcgacttactactgtcaacagacttacagtacccccccggagggccccactttcggccctgggaccaaggtggaaatcaaa

SEQ ID NO: 18721-18801 - skipped (81 entries)

SEQ ID NO: 18802 - protein, 121 aa, Artificial Sequence
  Description of Artificial Sequence: Synthetic polypeptide
EVQLVESGGGVVQPGRSLRLSCAASEFTFSTYAMHWVRQAPGKGLEWVALISYDGINKYYADSVKGRFAISRDNSKNTLYLQVNSLRADDTAVYYCVRPYSGSYTNWFDLWGQGTLVTVSS

SEQ ID NO: 18803 - protein, 26 aa, Artificial Sequence
  Description of Artificial Sequence: Synthetic peptide
EVQLVESGGGVVQPGRSLRLSCAASE

SEQ ID NO: 18804 - protein, 9 aa, Artificial Sequence
  Description of Artificial Sequence: Synthetic peptide
FTFSTYAMH

SEQ ID NO: 18805 - protein, 14 aa, Artificial Sequence
  Description of Artificial Sequence: Synthetic peptide
WVRQAPGKGLEWVA

SEQ ID NO: 18806 - protein, 17 aa, Artificial Sequence
  Description of Artificial Sequence: Synthetic peptide
LISYDGINKYYADSVKG

SEQ ID NO: 18807 - protein, 30 aa, Artificial Sequence
  Description of Artificial Sequence: Synthetic polypeptide
RFAISRDNSKNTLYLQVNSLRADDTAVYYC

SEQ ID NO: 18808 - protein, 14 aa, Artificial Sequence
  Description of Artificial Sequence: Synthetic peptide
VRPYSGSYTNWFDL

SEQ ID NO: 18809 - protein, 11 aa, Artificial Sequence
  Description of Artificial Sequence: Synthetic peptide
WGQGTLVTVSS

SEQ ID NO: 18810 - DNA, 363 bp, Artificial Sequence
  Description of Artificial Sequence: Synthetic polynucleotide
gaggtgcagctggtggagtctgggggaggcgtggtccagcctgggaggtccctgagactctcctgtgcagcctctgaattcaccttcagtacctatgctatgcactgggtccgccaggctccaggcaaggggctggagtgggtggcacttatatcatatgatggaatcaataagtactacgcagactccgtgaagggccgattcgccatctccagagacaattccaagaacacgctgtatctgcaagtgaatagcctgagagcagacgacacggctgtgtattattgtgtgaggccatatagtgggagctacacaaactggttcgacctctggggccagggaaccctggtcaccgtctcctca

SEQ ID NO: 18811 - skipped

SEQ ID NO: 18812 - protein, 107 aa, Artificial Sequence
  Description of Artificial Sequence: Synthetic polypeptide
EIVMTQSPGTLSSSPGERATLSCRASQSVSSRYLAWYQQKPGQAPRLLIYGTSNRATGIPDRFSGSGSGTDFTLTISRLEPEDFAVYYCQQYGSSYTFGPGTKLEIK

SEQ ID NO: 18813 - protein, 23 aa, Artificial Sequence
  Description of Artificial Sequence: Synthetic peptide
EIVMTQSPGTLSSSPGERATLSC

SEQ ID NO: 18814 - protein, 12 aa, Artificial Sequence
  Description of Artificial Sequence: Synthetic peptide
RASQSVSSRYLA

SEQ ID NO: 18815 - protein, 15 aa, Artificial Sequence
  Description of Artificial Sequence: Synthetic peptide
WYQQKPGQAPRLLIY

SEQ ID NO: 18816 - protein, 7 aa, Artificial Sequence
  Description of Artificial Sequence: Synthetic peptide
GTSNRAT

SEQ ID NO: 18817 - protein, 32 aa, Artificial Sequence; identical to SEQ ID NO: 2917
  Description of Artificial Sequence: Synthetic polypeptide

SEQ ID NO: 18818 - protein, 8 aa, Artificial Sequence
  Description of Artificial Sequence: Synthetic peptide
QQYGSSYT

SEQ ID NO: 18819 - protein, 10 aa, Artificial Sequence
  Description of Artificial Sequence: Synthetic peptide
FGPGTKLEIK

SEQ ID NO: 18820 - DNA, 321 bp, Artificial Sequence
  Description of Artificial Sequence: Synthetic polynucleotide
gaaattgtgatgacgcagtctccaggcaccctgtcttcgtctccaggggaaagagccaccctctcctgcagggccagtcagagtgttagcagcaggtacttagcctggtaccagcagaaacctggccaggctcccaggctcctcatctatggtacatccaacagggccactggcatcccagacaggttcagtggcagtgggtctgggacagacttcactctcaccatcagcagactggagcctgaagattttgcagtgtattactgtcagcagtatggtagctcgtacacttttggcccggggaccaagctggagatcaaa

SEQ ID NO: 18821-18901 - skipped (81 entries)

SEQ ID NO: 18902 - protein, 126 aa, Artificial Sequence
  Description of Artificial Sequence: Synthetic polypeptide
QVQLVQSGAEVKKPGSSVKVSCKASGGMLSDYAISWVRQAPGQRLEWMGGIMPAFGSPGYAQIFRGRATISADVSTSTAYLELTSLKPEDTAVYYCARDPSILNTGNHHWYDLDIWGQGTMVTVSS

SEQ ID NO: 18903 - protein, 26 aa, Artificial Sequence
  Description of Artificial Sequence: Synthetic peptide
QVQLVQSGAEVKKPGSSVKVSCKASG

SEQ ID NO: 18904 - protein, 9 aa, Artificial Sequence
  Description of Artificial Sequence: Synthetic peptide
GMLSDYAIS

SEQ ID NO: 18905 - protein, 14 aa, Artificial Sequence
  Description of Artificial Sequence: Synthetic peptide
WVRQAPGQRLEWMG

SEQ ID NO: 18906 - protein, 17 aa, Artificial Sequence
  Description of Artificial Sequence: Synthetic peptide
GIMPAFGSPGYAQIFRG

SEQ ID NO: 18907 - protein, 30 aa, Artificial Sequence; identical to SEQ ID NO: 3507
  Description of Artificial Sequence: Synthetic polypeptide

SEQ ID NO: 18908 - protein, 19 aa, Artificial Sequence
  Description of Artificial Sequence: Synthetic peptide
ARDPSILNTGNHHWYDLDI

SEQ ID NO: 18909 - protein, 11 aa, Artificial Sequence
  Description of Artificial Sequence: Synthetic peptide
WGQGTMVTVSS

SEQ ID NO: 18910 - DNA, 378 bp, Artificial Sequence
  Description of Artificial Sequence: Synthetic polynucleotide
caggtccagctggtacagtctggggctgaggtgaagaagcctgggtcctcggtgaaggtctcctgcaaggcttctggaggcatgctcagtgactatgccatcagttgggtgcgacaggcccctggacaacgacttgagtggatgggagggatcatgcctgcctttggttcgccaggctacgcacagattttccggggcagagccaccatttccgcggacgtatccacgagcacggcctacttggaactgaccagcctgaagcctgaggacacggccgtgtattattgtgcgagagacccgtctattcttaacactgggaatcaccactggtatgatttagatatctggggccaagggacaatggtcaccgtctcctca

SEQ ID NO: 18911 - skipped

SEQ ID NO: 18912 - protein, 112 aa, Artificial Sequence; identical to SEQ ID NO: 3512
  Description of Artificial Sequence: Synthetic polypeptide

SEQ ID NO: 18913 - protein, 23 aa, Artificial Sequence
  Description of Artificial Sequence: Synthetic peptide
DIVMTQSPLSLPVGLGQSASISC

SEQ ID NO: 18914 - protein, 16 aa, Artificial Sequence
  Description of Artificial Sequence: Synthetic peptide
RSSQRVVHTDGNTYLN

SEQ ID NO: 18915 - protein, 15 aa, Artificial Sequence
  Description of Artificial Sequence: Synthetic peptide
WFHQRPGQSPRRLIY

SEQ ID NO: 18916 - protein, 7 aa, Artificial Sequence
  Description of Artificial Sequence: Synthetic peptide
KVSNRDS

SEQ ID NO: 18917 - protein, 32 aa, Artificial Sequence; identical to SEQ ID NO: 3517
  Description of Artificial Sequence: Synthetic polypeptide

SEQ ID NO: 18918 - protein, 9 aa, Artificial Sequence
  Description of Artificial Sequence: Synthetic peptide
MQATEWPRT

SEQ ID NO: 18919 - protein, 10 aa, Artificial Sequence
  Description of Artificial Sequence: Synthetic peptide
FGQGTKVEIK

SEQ ID NO: 18920 - DNA, 336 bp, Artificial Sequence; identical to SEQ ID NO: 3520
  Description of Artificial Sequence: Synthetic polynucleotide

SEQ ID NO: 18921-19001 - skipped (81 entries)

SEQ ID NO: 19002 - protein, 126 aa, Artificial Sequence
  Description of Artificial Sequence: Synthetic polypeptide
QVQLVQSGAEVKMPGSSVKVSCKVSGGRFSDYAISWLRQAPLEGLEWMGGIVPHLNRKGYSQKFQDRLTFTADDSTSTAYMELSGLTSEDTAVYYCARDPTFLNTGNHFWYAVDIWGQGTTVTVSS

SEQ ID NO: 19003 - protein, 26 aa, Artificial Sequence
  Description of Artificial Sequence: Synthetic peptide
QVQLVQSGAEVKMPGSSVKVSCKVSG

SEQ ID NO: 19004 - protein, 9 aa, Artificial Sequence
  Description of Artificial Sequence: Synthetic peptide
GRFSDYAIS

SEQ ID NO: 19005 - protein, 14 aa, Artificial Sequence
  Description of Artificial Sequence: Synthetic peptide
WLRQAPLEGLEWMG

SEQ ID NO: 19006 - protein, 17 aa, Artificial Sequence
  Description of Artificial Sequence: Synthetic peptide
GIVPHLNRKGYSQKFQD

SEQ ID NO: 19007 - protein, 30 aa, Artificial Sequence
  Description of Artificial Sequence: Synthetic polypeptide
RLTFTADDSTSTAYMELSGLTSEDTAVYYC

SEQ ID NO: 19008 - protein, 19 aa, Artificial Sequence
  Description of Artificial Sequence: Synthetic peptide
ARDPTFLNTGNHFWYAVDI

SEQ ID NO: 19009 - protein, 11 aa, Artificial Sequence
  Description of Artificial Sequence: Synthetic peptide
WGQGTTVTVSS

SEQ ID NO: 19010 - DNA, 378 bp, Artificial Sequence
  Description of Artificial Sequence: Synthetic polynucleotide
caggtccagcttgtgcagtctggggctgaagtgaagatgcctgggtcgtcggtgaaggtctcctgtaaggtttccggagggagattcagtgactacgctattagctggctgcggcaggcccccctagaaggactcgagtggatggggggaatcgtccctcaccttaatagaaaaggatactcacagaagttccaggacagactcacctttactgcggacgactccaccagcaccgcctacatggagttgagtggcctgacgtctgaggacacggccgtttattactgtgcaagagatccgacttttcttaatactggaaatcacttctggtatgctgttgatatctggggccaagggaccacggtcaccgtctcctca

SEQ ID NO: 19011 - skipped

SEQ ID NO: 19012 - protein, 112 aa, Artificial Sequence
  Description of Artificial Sequence: Synthetic polypeptide
DIRLTQSPLSLSVTLGQAASISCTCSQSAVHSDGTTYFNWFHQRPGQSPRRLIYKVSNRDSGVPDRFIGSGSGTHFTLKISRVEAEDVGVYYCMQTTDWPRTFGQGTKVEIK

SEQ ID NO: 19013 - protein, 23 aa, Artificial Sequence
  Description of Artificial Sequence: Synthetic peptide
DIRLTQSPLSLSVTLGQAASISC

SEQ ID NO: 19014 - protein, 16 aa, Artificial Sequence
  Description of Artificial Sequence: Synthetic peptide
TCSQSAVHSDGTTYFN

SEQ ID NO: 19015 - protein, 15 aa, Artificial Sequence
  Description of Artificial Sequence: Synthetic peptide
WFHQRPGQSPRRLIY

SEQ ID NO: 19016 - protein, 7 aa, Artificial Sequence
  Description of Artificial Sequence: Synthetic peptide
KVSNRDS

SEQ ID NO: 19017 - protein, 32 aa, Artificial Sequence
  Description of Artificial Sequence: Synthetic polypeptide
GVPDRFIGSGSGTHFTLKISRVEAEDVGVYYC

SEQ ID NO: 19018 - protein, 9 aa, Artificial Sequence
  Description of Artificial Sequence: Synthetic peptide
MQTTDWPRT

SEQ ID NO: 19019 - protein, 10 aa, Artificial Sequence
  Description of Artificial Sequence: Synthetic peptide
FGQGTKVEIK

SEQ ID NO: 19020 - DNA, 336 bp, Artificial Sequence
  Description of Artificial Sequence: Synthetic polynucleotide
gacatccggttgacccagtctccactctccctgtccgtcacccttggacaggcggcctccatctcctgcacctgtagtcaatcggccgtgcacagcgatggaaccacctacttcaattggtttcaccagaggccaggccaatctccaaggcgcctcatttataaggtttctaatcgcgactctggggtcccagacagattcatcggcagtggctcaggcactcatttcacactgaaaatcagcagggtggaggctgaggatgttggggtttattactgcatgcaaactacagactggcctcggacgttcggccaagggaccaaggtggaaatcaaa

SEQ ID NO: 19021-19101 - skipped (81 entries)

SEQ ID NO: 19102 - protein, 129 aa, Artificial Sequence
  Description of Artificial Sequence: Synthetic polypeptide
QVQLVQSGAEVKKPGSSVKVSCKASGGTFSTHAISWVRQAPGHGPEWLGGILPLFGTSESAQRFQARVKITADESTSTAYMELSSLTSEDTAVYYCVRDSDPYTATSRNNHYWYAMDVWGQGTTVTVSS

SEQ ID NO: 19103 - protein, 26 aa, Artificial Sequence
  Description of Artificial Sequence: Synthetic peptide
QVQLVQSGAEVKKPGSSVKVSCKASG

SEQ ID NO: 19104 - protein, 9 aa, Artificial Sequence
  Description of Artificial Sequence: Synthetic peptide
GTFSTHAIS

SEQ ID NO: 19105 - protein, 14 aa, Artificial Sequence
  Description of Artificial Sequence: Synthetic peptide
WVRQAPGHGPEWLG

SEQ ID NO: 19106 - protein, 17 aa, Artificial Sequence
  Description of Artificial Sequence: Synthetic peptide
GILPLFGTSESAQRFQA

SEQ ID NO: 19107 - protein, 30 aa, Artificial Sequence; identical to SEQ ID NO: 5907
  Description of Artificial Sequence: Synthetic polypeptide

SEQ ID NO: 19108 - protein, 22 aa, Artificial Sequence
  Description of Artificial Sequence: Synthetic peptide
VRDSDPYTATSRNNHYWYAMDV

SEQ ID NO: 19109 - protein, 11 aa, Artificial Sequence
  Description of Artificial Sequence: Synthetic peptide
WGQGTTVTVSS

SEQ ID NO: 19110 - DNA, 387 bp, Artificial Sequence
  Description of Artificial Sequence: Synthetic polynucleotide
caggtccagcttgtacagtctggggctgaggtgaagaagcctgggtcctcggtgaaggtctcctgcaaggcttctggaggcaccttcagcacccatgctatcagctgggtgcgacaggcccctggacatgggcctgagtggctgggagggatcctccccctttttggtacatcagaatccgcacagaggttccaggccagagtcaagattaccgcggacgaatccacgagcacagcctacatggagctgagtagcctgacatctgaagacacggccgtttattactgtgtgagagactctgacccctatacggcgactagcaggaataatcactactggtatgctatggacgtctggggccaagggaccacggtcaccgtctcctca

SEQ ID NO: 19111 - skipped

SEQ ID NO: 19112 - protein, 112 aa, Artificial Sequence
  Description of Artificial Sequence: Synthetic polypeptide
ETTLTQSPLSLPVTLGQPASISCRSSQSVVHSDGNTYLNWFHQRPGQSPRRLIYKVSNRDSGVPDRFSGSGSGTDFTLKISRVEAEDIGVYYCMQGTDWPRTFGQGTKVEIK

SEQ ID NO: 19113 - protein, 23 aa, Artificial Sequence
  Description of Artificial Sequence: Synthetic peptide
ETTLTQSPLSLPVTLGQPASISC

SEQ ID NO: 19114 - protein, 16 aa, Artificial Sequence
  Description of Artificial Sequence: Synthetic peptide
RSSQSVVHSDGNTYLN

SEQ ID NO: 19115 - protein, 15 aa, Artificial Sequence
  Description of Artificial Sequence: Synthetic peptide
WFHQRPGQSPRRLIY

SEQ ID NO: 19116 - protein, 7 aa, Artificial Sequence
  Description of Artificial Sequence: Synthetic peptide
KVSNRDS

SEQ ID NO: 19117 - protein, 32 aa, Artificial Sequence; identical to SEQ ID NO: 1317
  Description of Artificial Sequence: Synthetic polypeptide

SEQ ID NO: 19118 - protein, 9 aa, Artificial Sequence
  Description of Artificial Sequence: Synthetic peptide
MQGTDWPRT

SEQ ID NO: 19119 - protein, 10 aa, Artificial Sequence
  Description of Artificial Sequence: Synthetic peptide
FGQGTKVEIK

SEQ ID NO: 19120 - DNA, 336 bp, Artificial Sequence
  Description of Artificial Sequence: Synthetic polynucleotide
gaaacgacactcacgcagtctccactctccctgcccgtcacccttggacagccggcctccatctcctgcaggtctagtcaaagcgtcgtacacagtgatggaaacacctacttgaattggtttcaccagaggccaggccaatctccaaggcgcctaatttataaggtttctaatcgggactctggggtcccagacagattcagcggcagtgggtcaggcactgacttcacactgaaaatcagcagggtggaggctgaagatattggggtttattactgcatgcaaggtacagactggcctcggacttttggccaggggaccaaggtggagatcaaa

SEQ ID NO: 19121-19201 - skipped (81 entries)

SEQ ID NO: 19202 - protein, 126 aa, Artificial Sequence
  Description of Artificial Sequence: Synthetic polypeptide
QVQLVQSGAEVKKPGSSVKVSCKVSGGTFSNYAISWLRQAPGQGPEWMGGIIPALSRVGYVRKFQARLTISADELTTTAYMDLSSLTSEDTAVYYCARDPSFLNTGNHFWYDFDLWGQGTTVTVSS

SEQ ID NO: 19203 - protein, 26 aa, Artificial Sequence
  Description of Artificial Sequence: Synthetic peptide
QVQLVQSGAEVKKPGSSVKVSCKVSG

SEQ ID NO: 19204 - protein, 9 aa, Artificial Sequence
  Description of Artificial Sequence: Synthetic peptide
GTFSNYAIS

SEQ ID NO: 19205 - protein, 14 aa, Artificial Sequence
  Description of Artificial Sequence: Synthetic peptide
WLRQAPGQGPEWMG

SEQ ID NO: 19206 - protein, 17 aa, Artificial Sequence
  Description of Artificial Sequence: Synthetic peptide
GIIPALSRVGYVRKFQA

SEQ ID NO: 19207 - protein, 30 aa, Artificial Sequence; identical to SEQ ID NO: 4307
  Description of Artificial Sequence: Synthetic polypeptide

SEQ ID NO: 19208 - protein, 19 aa, Artificial Sequence
  Description of Artificial Sequence: Synthetic peptide
ARDPSFLNTGNHFWYDFDL

SEQ ID NO: 19209 - protein, 11 aa, Artificial Sequence
  Description of Artificial Sequence: Synthetic peptide
WGQGTTVTVSS

SEQ ID NO: 19210 - DNA, 378 bp, Artificial Sequence
  Description of Artificial Sequence: Synthetic polynucleotide
caggtccagctggtgcagtctggggctgaagtgaagaagcctgggtcctcggtgaaggtctcctgcaaggtttctggaggcaccttcagtaactacgctatcagttggctgcgacaggcccctggacaagggcctgagtggatgggagggatcatccctgcattgagtagagtaggctatgttcggaagtttcaggccagactcacaattagcgcggacgaattgacgactacagcctacatggacctgagtagcctaacgtctgaggacacggccgtctactactgtgcgagagatccgtcttttctgaatactgggaatcacttctggtatgattttgatttgtggggccaagggaccacggtcaccgtctcctca

SEQ ID NO: 19211 - skipped

SEQ ID NO: 19212 - protein, 112 aa, Artificial Sequence
  Description of Artificial Sequence: Synthetic polypeptide
ETTLTQSPLSLPVTLGQPASISCTSSQTVVHTDRNTYLNWYHQRPGQSPRRLIYKVSNRDSGVPDRFSGSGSGSHFTLKISRVEAEDVGVYYCMQGTEWPRTFGQGTKLEIK

SEQ ID NO: 19213 - protein, 23 aa, Artificial Sequence
  Description of Artificial Sequence: Synthetic peptide
ETTLTQSPLSLPVTLGQPASISC

SEQ ID NO: 19214 - protein, 16 aa, Artificial Sequence
  Description of Artificial Sequence: Synthetic peptide
TSSQTVVHTDRNTYLN

SEQ ID NO: 19215 - protein, 15 aa, Artificial Sequence
  Description of Artificial Sequence: Synthetic peptide
WYHQRPGQSPRRLIY

SEQ ID NO: 19216 - protein, 7 aa, Artificial Sequence
  Description of Artificial Sequence: Synthetic peptide
KVSNRDS

SEQ ID NO: 19217 - protein, 32 aa, Artificial Sequence
  Description of Artificial Sequence: Synthetic polypeptide
GVPDRFSGSGSGSHFTLKISRVEAEDVGVYYC

SEQ ID NO: 19218 - protein, 9 aa, Artificial Sequence
  Description of Artificial Sequence: Synthetic peptide
MQGTEWPRT

SEQ ID NO: 19219 - protein, 10 aa, Artificial Sequence
  Description of Artificial Sequence: Synthetic peptide
FGQGTKLEIK

SEQ ID NO: 19220 - DNA, 336 bp, Artificial Sequence
  Description of Artificial Sequence: Synthetic polynucleotide
gaaacgacactcacgcagtctccactctccctgcccgtcacccttggacagccggcctccatctcctgcacgtccagtcaaaccgtcgtccacactgatagaaacacctacttgaattggtatcaccagaggccaggccaatctccaaggcgcctcatttataaggtttctaaccgggactctggggtcccagacaggttcagcggcagtgggtcaggctctcatttcacactgaagatcagcagggtggaggctgaggatgttggggtttattactgcatgcaaggaacagagtggcctcggacgttcggccaagggaccaagctggagatcaaa

SEQ ID NO: 19221-19301 - skipped (81 entries)

SEQ ID NO: 19302 - protein, 126 aa, Artificial Sequence
  Description of Artificial Sequence: Synthetic polypeptide
QVQLQQWGAGLLKPSETLSLTCAVYGGSFSGFYWTWIRQPPGKGLEWIGEINHSGSSNYDLSLKSRVTMSVDTSKNQFSLKLSSVTAADTAVYYCARGMISPRIPRTTRQRWFDTWGQGTLVTVSS

SEQ ID NO: 19303 - protein, 26 aa, Artificial Sequence
  Description of Artificial Sequence: Synthetic peptide
QVQLQQWGAGLLKPSETLSLTCAVYG

SEQ ID NO: 19304 - protein, 9 aa, Artificial Sequence
  Description of Artificial Sequence: Synthetic peptide
GSFSGFYWT

SEQ ID NO: 19305 - protein, 14 aa, Artificial Sequence
  Description of Artificial Sequence: Synthetic peptide
WIRQPPGKGLEWIG

SEQ ID NO: 19306 - protein, 16 aa, Artificial Sequence
  Description of Artificial Sequence: Synthetic peptide
EINHSGSSNYDLSLKS

SEQ ID NO: 19307 - protein, 30 aa, Artificial Sequence
  Description of Artificial Sequence: Synthetic polypeptide
RVTMSVDTSKNQFSLKLSSVTAADTAVYYC

SEQ ID NO: 19308 - protein, 20 aa, Artificial Sequence
  Description of Artificial Sequence: Synthetic peptide
ARGMISPRIPRTTRQRWFDT

SEQ ID NO: 19309 - protein, 11 aa, Artificial Sequence
  Description of Artificial Sequence: Synthetic peptide
WGQGTLVTVSS

SEQ ID NO: 19310 - DNA, 378 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccttcagtggtttctactggacctggatccgccagcccccagggaaggggctggagtggattggggaaatcaatcatagtggaagcagcaactacgacttgtccctcaagagtcgagtcaccatgtcagtagacacgtccaagaaccagttctccctgaaactgagctctgtgaccgccgcggacacggctgtgtactactgtgcgagaggcatgataagtcctcggattcccaggaccacccgccaacgttggttcgacacatggggccagggaaccctggtcaccgtctcctca

SEQ ID NO: 19311 - skipped

SEQ ID NO: 19312 - protein, 110 aa, Artificial Sequence
  Description of Artificial Sequence: Synthetic polypeptide
QPGLTQPASVSGSPGQSITISCTGTSGDVGSDNLVSWYQRHPGKAPKLMIYEGSKRPSGVSHRFSGSNSGNTASLTISGLQAEDDADYYCCSYAGDDTVVFGGGTKLTVL

SEQ ID NO: 19313 - protein, 22 aa, Artificial Sequence
  Description of Artificial Sequence: Synthetic peptide
QPGLTQPASVSGSPGQSITISC

SEQ ID NO: 19314 - protein, 14 aa, Artificial Sequence
  Description of Artificial Sequence: Synthetic peptide
TGTSGDVGSDNLVS

SEQ ID NO: 19315 - protein, 15 aa, Artificial Sequence
  Description of Artificial Sequence: Synthetic peptide
WYQRHPGKAPKLMIY

SEQ ID NO: 19316 - protein, 7 aa, Artificial Sequence
  Description of Artificial Sequence: Synthetic peptide
EGSKRPS

SEQ ID NO: 19317 - protein, 32 aa, Artificial Sequence
  Description of Artificial Sequence: Synthetic polypeptide
GVSHRFSGSNSGNTASLTISGLQAEDDADYYC

SEQ ID NO: 19318 - protein, 10 aa, Artificial Sequence
  Description of Artificial Sequence: Synthetic peptide
CSYAGDDTVV

SEQ ID NO: 19319 - protein, 10 aa, Artificial Sequence
  Description of Artificial Sequence: Synthetic peptide
FGGGTKLTVL

SEQ ID NO: 19320 - DNA, 330 bp, Artificial Sequence
  Description of Artificial Sequence: Synthetic polynucleotide
cagcctgggctgactcagcctgcctccgtgtctgggtctcctggacagtcgatcaccatctcctgcactggaaccagcggtgatgttgggagtgataaccttgtctcctggtaccaacgacacccaggcaaagcccccaaactcatgatttatgagggcagtaagcggccctcaggggtttctcatcgcttctctggctccaactctggcaacacggcctccctgacgatctctgggctccaggctgaggacgacgctgattattactgctgctcatatgcaggtgatgacactgtggtattcggcggagggaccaagctgaccgtccta

SEQ ID NO: 19321-19401 - skipped (81 entries)

SEQ ID NO: 19402 - protein, 127 aa, Artificial Sequence
  Description of Artificial Sequence: Synthetic polypeptide
QVQLQQWGAGLLKPSETLSLTCGVYGGSFSGYFWSWIRQSPGKGLEWIGEINHSRSMSYNPSLKSRITMSVDTSKNQFSLNLNSVTAADTAVYFCARGKAHRNDFWSGYYPHWFDPWGQGILVTVSS

SEQ ID NO: 19403 - protein, 26 aa, Artificial Sequence
  Description of Artificial Sequence: Synthetic peptide
QVQLQQWGAGLLKPSETLSLTCGVYG

SEQ ID NO: 19404 - protein, 9 aa, Artificial Sequence
  Description of Artificial Sequence: Synthetic peptide
GSFSGYFWS

SEQ ID NO: 19405 - protein, 14 aa, Artificial Sequence
  Description of Artificial Sequence: Synthetic peptide
WIRQSPGKGLEWIG

SEQ ID NO: 19406 - protein, 16 aa, Artificial Sequence
  Description of Artificial Sequence: Synthetic peptide
EINHSRSMSYNPSLKS

SEQ ID NO: 19407 - protein, 30 aa, Artificial Sequence
  Description of Artificial Sequence: Synthetic polypeptide
RITMSVDTSKNQFSLNLNSVTAADTAVYFC

SEQ ID NO: 19408 - protein, 21 aa, Artificial Sequence
  Description of Artificial Sequence: Synthetic peptide
ARGKAHRNDFWSGYYPHWFDP

SEQ ID NO: 19409 - protein, 11 aa, Artificial Sequence
  Description of Artificial Sequence: Synthetic peptide
WGQGILVTVSS

SEQ ID NO: 19410 - DNA, 381 bp, Artificial Sequence
  Description of Artificial Sequence: Synthetic polynucleotide
caggtgcagctacagcagtggggcgcaggactgttgaagccttcggagaccctgtccctcacctgcggtgtctatggtgggtccttcagtggttacttctggagctggatccgccagtccccagggaaggggctggagtggattggggaaatcaatcatagtagaagtatgagctacaacccgtccctcaagagtcgaataaccatgtcagtagacacgtccaagaaccagttctccctgaacctgaactctgtgaccgccgcggacacggctgtatatttttgtgcgagaggaaaggctcaccgcaacgatttttggagtggttattatccgcactggttcgacccctggggccagggaatcctggtcactgtctcctca

SEQ ID NO: 19411 - skipped

SEQ ID NO: 19412 - protein, 108 aa, Artificial Sequence
  Description of Artificial Sequence: Synthetic polypeptide
DIVLTQSPGTLSLSPGERVTLSCRASQSISSNYLAWYQQKPGQAPRLLISDASSRATGIPDRFSGSGSGADFTLIISRLEPEDFAVYFCHQYGGSPTTFGQGTKVEIK

SEQ ID NO: 19413 - protein, 23 aa, Artificial Sequence
  Description of Artificial Sequence: Synthetic peptide
DIVLTQSPGTLSLSPGERVTLSC

SEQ ID NO: 19414 - protein, 12 aa, Artificial Sequence
  Description of Artificial Sequence: Synthetic peptide
RASQSISSNYLA

SEQ ID NO: 19415 - protein, 15 aa, Artificial Sequence
  Description of Artificial Sequence: Synthetic peptide
WYQQKPGQAPRLLIS

SEQ ID NO: 19416 - protein, 7 aa, Artificial Sequence
  Description of Artificial Sequence: Synthetic peptide
DASSRAT

SEQ ID NO: 19417 - protein, 32 aa, Artificial Sequence
  Description of Artificial Sequence: Synthetic polypeptide
GIPDRFSGSGSGADFTLIISRLEPEDFAVYFC

SEQ ID NO: 19418 - protein, 9 aa, Artificial Sequence
  Description of Artificial Sequence: Synthetic peptide
HQYGGSPTT

SEQ ID NO: 19419 - protein, 10 aa, Artificial Sequence
  Description of Artificial Sequence: Synthetic peptide
FGQGTKVEIK

SEQ ID NO: 19420 - DNA, 324 bp, Artificial Sequence
  Description of Artificial Sequence: Synthetic polynucleotide
gatattgtgctgacccagtctccaggcaccctgtctttgtctccaggggaaagagtcaccctctcctgcagggccagtcagagtattagcagcaactacttagcctggtaccagcagaaacctggccaggctcccaggctcctcatctctgatgcatccagcagggccactggcatcccagacaggttcagtggcagtgggtctggggccgacttcactctcatcatcagcagactggagcctgaagattttgcagtgtatttctgtcaccagtatggtgggtcaccgaccacttttggccaggggaccaaggtggaaatcaaa

SEQ ID NO: 19421-19501 - skipped (81 entries)

SEQ ID NO: 19502 - protein, 129 aa, Artificial Sequence
  Description of Artificial Sequence: Synthetic polypeptide
QVQLVQSGAEVKKPGSSVKISCKISGDTFSTNAISWLRQAPGREPEWMGGIVPLVGPASYAQRPQGRLTITADEFTNTAYLELNSLRSEDTATYYCARDSDPYTATRRHNHYWYAMDVWGQGTTVTVSS

SEQ ID NO: 19503 - protein, 26 aa, Artificial Sequence
  Description of Artificial Sequence: Synthetic peptide
QVQLVQSGAEVKKPGSSVKISCKISG

SEQ ID NO: 19504 - protein, 9 aa, Artificial Sequence
  Description of Artificial Sequence: Synthetic peptide
DTFSTNAIS

SEQ ID NO: 19505 - protein, 14 aa, Artificial Sequence
  Description of Artificial Sequence: Synthetic peptide
WLRQAPGREPEWMG

SEQ ID NO: 19506 - protein, 17 aa, Artificial Sequence
  Description of Artificial Sequence: Synthetic peptide
GIVPLVGPASYAQRPQG

SEQ ID NO: 19507 - protein, 30 aa, Artificial Sequence; identical to SEQ ID NO: 9607
  Description of Artificial Sequence: Synthetic polypeptide

SEQ ID NO: 19508 - protein, 22 aa, Artificial Sequence
  Description of Artificial Sequence: Synthetic peptide
ARDSDPYTATRRHNHYWYAMDV

SEQ ID NO: 19509 - protein, 11 aa, Artificial Sequence
  Description of Artificial Sequence: Synthetic peptide
WGQGTTVTVSS

SEQ ID NO: 19510 - DNA, 387 bp, Artificial Sequence
  Description of Artificial Sequence: Synthetic polynucleotide
caggtgcagctggtgcagtctggggctgaggtgaagaaacctgggtcctcggtgaagatctcctgcaagatttctggagacactttcagcaccaatgctattagttggttgcgacaggcccctgggcgagagcctgaatggatggggggcatcgtccctctggttggccctgcaagctatgcccagaggccccagggccgattgacgattaccgcggacgaatttaccaacacagcctacttggaactgaacagcctgagatctgaggacacggccacatattactgtgcaagagactctgacccctatacggcgactagaaggcacaatcactattggtatgccatggacgtctggggccaagggaccacggtcaccgtctcttca

SEQ ID NO: 19511 - skipped

SEQ ID NO: 19512 - protein, 112 aa, Artificial Sequence
  Description of Artificial Sequence: Synthetic polypeptide
ETTLTQSPLSLPVTLGQPASISCRSSQIAMHSDGNTYLSWFHQRPGQPPRRLIYKISNRDSGVPDRFSGSGSGTDFTLKISRVEAEDIGTFYCMQGTDWPRTFGQGTKVEIK

SEQ ID NO: 19513 - protein, 23 aa, Artificial Sequence
  Description of Artificial Sequence: Synthetic peptide
ETTLTQSPLSLPVTLGQPASISC

SEQ ID NO: 19514 - protein, 16 aa, Artificial Sequence
  Description of Artificial Sequence: Synthetic peptide
RSSQIAMHSDGNTYLS

SEQ ID NO: 19515 - protein, 15 aa, Artificial Sequence
  Description of Artificial Sequence: Synthetic peptide
WFHQRPGQPPRRLIY

SEQ ID NO: 19516 - protein, 7 aa, Artificial Sequence
  Description of Artificial Sequence: Synthetic peptide
KISNRDS

SEQ ID NO: 19517 - protein, 32 aa, Artificial Sequence; identical to SEQ ID NO: 9617
  Description of Artificial Sequence: Synthetic polypeptide

SEQ ID NO: 19518 - protein, 9 aa, Artificial Sequence
  Description of Artificial Sequence: Synthetic peptide
MQGTDWPRT

SEQ ID NO: 19519 - protein, 10 aa, Artificial Sequence
  Description of Artificial Sequence: Synthetic peptide
FGQGTKVEIK

SEQ ID NO: 19520 - DNA, 336 bp, Artificial Sequence
  Description of Artificial Sequence: Synthetic polynucleotide
gaaacgacactcacgcagtctcccctgtccctgcccgtcacccttggacagccggcctccatctcctgcaggtctagtcaaatcgccatgcacagtgatggcaacacctacttgagttggtttcaccagaggccaggccaacctccacggcgcctaatttataagatttccaatcgggactctggggtcccagacagattcagcggcagtgggtcaggcacagacttcacactgaaaatcagtagggtggaggctgaggatattggaactttttattgcatgcaaggtacagactggcctcggacttttggccaggggaccaaggtggaaatcaaa

SEQ ID NO: 19521-19601 - skipped (81 entries)

SEQ ID NO: 19602 - protein, 129 aa, Artificial Sequence
  Description of Artificial Sequence: Synthetic polypeptide
EVQLLESGPGLVKPSETLSLTCTVSGGSINSQYWNWIRQSPGKGLEWIGYVYYSGSTNYNPSLKSRVTMSVDTSKNHFSLNLRSVTAADTAVYYCARGLVVRYFDGFPSGPIIGAFDIWNQGTTVTVSS

SEQ ID NO: 19603 - protein, 26 aa, Artificial Sequence
  Description of Artificial Sequence: Synthetic peptide
EVQLLESGPGLVKPSETLSLTCTVSG

SEQ ID NO: 19604 - protein, 9 aa, Artificial Sequence
  Description of Artificial Sequence: Synthetic peptide
GSINSQYWN

SEQ ID NO: 19605 - protein, 14 aa, Artificial Sequence
  Description of Artificial Sequence: Synthetic peptide
WIRQSPGKGLEWIG

SEQ ID NO: 19606 - protein, 16 aa, Artificial Sequence
  Description of Artificial Sequence: Synthetic peptide
YVYYSGSTNYNPSLKS

SEQ ID NO: 19607 - protein, 30 aa, Artificial Sequence
  Description of Artificial Sequence: Synthetic polypeptide
RVTMSVDTSKNHFSLNLRSVTAADTAVYYC

SEQ ID NO: 19608 - protein, 23 aa, Artificial Sequence
  Description of Artificial Sequence: Synthetic peptide
ARGLVVRYFDGFPSGPIIGAFDI

SEQ ID NO: 19609 - protein, 11 aa, Artificial Sequence
  Description of Artificial Sequence: Synthetic peptide
WNQGTTVTVSS

SEQ ID NO: 19610 - DNA, 387 bp, Artificial Sequence
  Description of Artificial Sequence: Synthetic polynucleotide
gaggtgcagctgttggagtcgggcccaggactggtgaagccttcggagaccctgtccctcacctgcactgtctctggtggttccatcaatagtcagtactggaactggattcggcagtcccccgggaagggactggagtggattggatatgtctattacagtgggagcaccaactacaacccctccctcaagagtcgagtcaccatgtcagtggacacgtccaagaatcacttctccctgaacctgaggtctgtgaccgctgcggacacggccgtgtattactgcgcgagaggcctagtggtacgatattttgatggattcccatccggcccgattatcggtgcttttgatatctggaaccaagggaccacggtcaccgtctcctca

SEQ ID NO: 19611 - skipped

SEQ ID NO: 19612 - protein, 106 aa, Artificial Sequence
  Description of Artificial Sequence: Synthetic polypeptide
ETTLTQSPATLSLSPGERATLSCRASQSVSSYLAWYQQKPGQAPRLLIYDAFNRATGVPARFSGSGSGTDFTLTISSLEPEDFAVYYCQQRTSTLTFGGGTKVDIK

SEQ ID NO: 19613 - protein, 23 aa, Artificial Sequence
  Description of Artificial Sequence: Synthetic peptide
ETTLTQSPATLSLSPGERATLSC

SEQ ID NO: 19614 - protein, 11 aa, Artificial Sequence
  Description of Artificial Sequence: Synthetic peptide
RASQSVSSYLA

SEQ ID NO: 19615 - protein, 15 aa, Artificial Sequence
  Description of Artificial Sequence: Synthetic peptide
WYQQKPGQAPRLLIY

SEQ ID NO: 19616 - protein, 7 aa, Artificial Sequence
  Description of Artificial Sequence: Synthetic peptide
DAFNRAT

SEQ ID NO: 19617 - protein, 32 aa, Artificial Sequence
  Description of Artificial Sequence: Synthetic polypeptide
GVPARFSGSGSGTDFTLTISSLEPEDFAVYYC

SEQ ID NO: 19618 - protein, 8 aa, Artificial Sequence
  Description of Artificial Sequence: Synthetic peptide
QQRTSTLT

SEQ ID NO: 19619 - protein, 10 aa, Artificial Sequence
  Description of Artificial Sequence: Synthetic peptide
FGGGTKVDIK

SEQ ID NO: 19620 - DNA, 318 bp, Artificial Sequence
  Description of Artificial Sequence: Synthetic polynucleotide
gaaacgacactcacgcagtctccagccaccctgtctttgtctccaggggaaagagccaccctctcctgcagggccagtcagagtgttagcagctacttagcctggtaccaacagaaacctggccaggctcccaggctcctcatctatgatgcattcaacagggccactggcgtcccagccaggttcagtggcagtgggtctgggacagacttcactctcaccatcagcagcctagagcctgaagattttgcagtttattactgtcagcagcgtacctcaacgctcactttcggcggagggaccaaagtggatatcaaa

SEQ ID NO: 19621-19701 - skipped (81 entries)

SEQ ID NO: 19702 - protein, 129 aa, Artificial Sequence
  Description of Artificial Sequence: Synthetic polypeptide
QVQLVQSGAEVKKPGSSVKVSCKVSGGTFSSHAISWVRQAPGQRPEWMGGIMPIFGESKDTQKFQGRVTFTVDESTNTAYMELTSLKSEDTAIYYCVRDPDPYTATVRHNHYWHGMDVWGQGTTVTVSS

SEQ ID NO: 19703 - protein, 26 aa, Artificial Sequence
  Description of Artificial Sequence: Synthetic peptide
QVQLVQSGAEVKKPGSSVKVSCKVSG

SEQ ID NO: 19704 - protein, 9 aa, Artificial Sequence
  Description of Artificial Sequence: Synthetic peptide
GTFSSHAIS

SEQ ID NO: 19705 - protein, 14 aa, Artificial Sequence
  Description of Artificial Sequence: Synthetic peptide
WVRQAPGQRPEWMG

SEQ ID NO: 19706 - protein, 17 aa, Artificial Sequence
  Description of Artificial Sequence: Synthetic peptide
GIMPIFGESKDTQKFQG

SEQ ID NO: 19707 - protein, 30 aa, Artificial Sequence
  Description of Artificial Sequence: Synthetic polypeptide
RVTFTVDESTNTAYMELTSLKSEDTAIYYC

SEQ ID NO: 19708 - protein, 22 aa, Artificial Sequence
  Description of Artificial Sequence: Synthetic peptide
VRDPDPYTATVRHNHYWHGMDV

SEQ ID NO: 19709 - protein, 11 aa, Artificial Sequence
  Description of Artificial Sequence: Synthetic peptide
WGQGTTVTVSS

SEQ ID NO: 19710 - DNA, 387 bp, Artificial Sequence
  Description of Artificial Sequence: Synthetic polynucleotide
caggtccagctggtgcagtctggggctgaggtgaagaagcctgggtcctcggtgaaggtctcctgcaaggtttctggaggcaccttcagcagtcatgctattagctgggtgcgacaggcccctggacaacggcctgaatggatgggagggatcatgcctatttttggcgagtcaaaggacacacagaagtttcagggcagggtcacctttaccgtggacgaatctacgaatacagcctatatggagttgacgagcctaaaatccgaagacacggccatatattactgtgtgagagaccctgacccctacacggcgactgtcaggcacaaccactattggcatggtatggacgtctggggccaagggaccacggtcactgtctcctca

SEQ ID NO: 19711 - skipped

SEQ ID NO: 19712 - protein, 112 aa, Artificial Sequence
  Description of Artificial Sequence: Synthetic polypeptide
ETTLTQSPLSLPVTLGQAASISCRSSQAVVHSDGNTYLNWFQQRPGQPPRRLIYKVSNRDSGVPDRFSGSGSGTVFTLKISRVEAEDIGVYYCMQGTEWPRTFGQGTKVEIK

SEQ ID NO: 19713 - protein, 23 aa, Artificial Sequence
  Description of Artificial Sequence: Synthetic peptide
ETTLTQSPLSLPVTLGQAASISC

SEQ ID NO: 19714 - protein, 16 aa, Artificial Sequence
  Description of Artificial Sequence: Synthetic peptide
RSSQAVVHSDGNTYLN

SEQ ID NO: 19715 - protein, 15 aa, Artificial Sequence
  Description of Artificial Sequence: Synthetic peptide
WFQQRPGQPPRRLIY

SEQ ID NO: 19716 - protein, 7 aa, Artificial Sequence
  Description of Artificial Sequence: Synthetic peptide
KVSNRDS

SEQ ID NO: 19717 - protein, 32 aa, Artificial Sequence
  Description of Artificial Sequence: Synthetic polypeptide
GVPDRFSGSGSGTVFTLKISRVEAEDIGVYYC

SEQ ID NO: 19718 - protein, 9 aa, Artificial Sequence
  Description of Artificial Sequence: Synthetic peptide
MQGTEWPRT

SEQ ID NO: 19719 - protein, 10 aa, Artificial Sequence
  Description of Artificial Sequence: Synthetic peptide
FGQGTKVEIK

SEQ ID NO: 19720 - DNA, 336 bp, Artificial Sequence
  Description of Artificial Sequence: Synthetic polynucleotide
gaaacgacactcacgcagtctccactctccctgcccgtcacccttggacaggcggcctccatctcctgcaggtctagtcaagccgtcgtgcacagtgatggaaacacctacttgaattggtttcagcagaggccaggccagcctccaaggcgcctcatttataaggtttctaaccgggactctggggtcccagacagattcagcggcagtgggtcaggcactgtcttcacactgaaaatcagcagggtggaggctgaggatattggggtttattactgcatgcaaggtacagagtggcctcggacttttggccaggggaccaaggtggagatcaaa

SEQ ID NO: 19721-19801 - skipped (81 entries)

SEQ ID NO: 19802 - protein, 129 aa, Artificial Sequence
  Description of Artificial Sequence: Synthetic polypeptide
EVQLLESGPGLVKPSETLSLTCTVSGGSISSNNLYWGWIRQPPGKGLEWIGSIYYSGSTYYNPSLKSRVIIPVDTSKDQFSLRLSSVTAADTAVYYCARHSQKDIVLIPAAQSPIFDYWGQGTLVTVSS

SEQ ID NO: 19803 - protein, 26 aa, Artificial Sequence
  Description of Artificial Sequence: Synthetic peptide
EVQLLESGPGLVKPSETLSLTCTVSG

SEQ ID NO: 19804 - protein, 11 aa, Artificial Sequence
  Description of Artificial Sequence: Synthetic peptide
GSISSNNLYWG

SEQ ID NO: 19805 - protein, 14 aa, Artificial Sequence
  Description of Artificial Sequence: Synthetic peptide
WIRQPPGKGLEWIG

SEQ ID NO: 19806 - protein, 16 aa, Artificial Sequence
  Description of Artificial Sequence: Synthetic peptide
SIYYSGSTYYNPSLKS

SEQ ID NO: 19807 - protein, 30 aa, Artificial Sequence
  Description of Artificial Sequence: Synthetic polypeptide
RVIIPVDTSKDQFSLRLSSVTAADTAVYYC

SEQ ID NO: 19808 - protein, 21 aa, Artificial Sequence
  Description of Artificial Sequence: Synthetic peptide
ARHSQKDIVLIPAAQSPIFDY

SEQ ID NO: 19809 - protein, 11 aa, Artificial Sequence
  Description of Artificial Sequence: Synthetic peptide
WGQGTLVTVSS

SEQ ID NO: 19810 - DNA, 387 bp, Artificial Sequence
  Description of Artificial Sequence: Synthetic polynucleotide
gaggtgcagctgttggagtcgggcccaggactggtgaagccttcggagaccctgtccctcacctgcactgtctctggtggctccatcagcagtaataatctctactggggctggatccgccagcccccagggaaggggctggagtggattggaagtatttattatagtgggagcacctactacaacccgtccctcaagagtcgagtcatcatacccgtagacacgtccaaggaccagttctccctgaggctgagctctgtgaccgccgcagatacggctgtctattactgtgcgcgacattcacagaaggatattgtactaataccagctgctcaatccccgatatttgactactggggccagggaaccctggtcaccgtctcctca

SEQ ID NO: 19811 - skipped

SEQ ID NO: 19812 - protein, 110 aa, Artificial Sequence
  Description of Artificial Sequence: Synthetic polypeptide
QSVLTQPPSVSATPGQKVTISCSGSSSNIGNNYVSWYQQLPGTAPKLLIYDNNKRPSGIPDRFSGSKSGTSATLGITGLQTGDEADYYCGTWDSRLSAVVFGGGTKLTVL

SEQ ID NO: 19813 - protein, 22 aa, Artificial Sequence
  Description of Artificial Sequence: Synthetic peptide
QSVLTQPPSVSATPGQKVTISC

SEQ ID NO: 19814 - protein, 13 aa, Artificial Sequence
  Description of Artificial Sequence: Synthetic peptide
SGSSSNIGNNYVS

SEQ ID NO: 19815 - protein, 15 aa, Artificial Sequence
  Description of Artificial Sequence: Synthetic peptide
WYQQLPGTAPKLLIY

SEQ ID NO: 19816 - protein, 7 aa, Artificial Sequence
  Description of Artificial Sequence: Synthetic peptide
DNNKRPS

SEQ ID NO: 19817 - protein, 32 aa, Artificial Sequence; identical to SEQ ID NO: 2117
  Description of Artificial Sequence: Synthetic polypeptide

SEQ ID NO: 19818 - protein, 11 aa, Artificial Sequence
  Description of Artificial Sequence: Synthetic peptide
GTWDSRLSAVV

SEQ ID NO: 19819 - protein, 10 aa, Artificial Sequence
  Description of Artificial Sequence: Synthetic peptide
FGGGTKLTVL

SEQ ID NO: 19820 - DNA, 330 bp, Artificial Sequence
  Description of Artificial Sequence: Synthetic polynucleotide
cagtctgtgctgacgcagccgccctcagtgtctgcgaccccaggacagaaggtcaccatctcctgctctggaagcagctccaacattgggaataattatgtatcctggtaccagcaactcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagactgagtgctgtggtattcggcggagggaccaagctcaccgtccta

SEQ ID NO: 19821-19901 - skipped (81 entries)

SEQ ID NO: 19902 - protein, 121 aa, Artificial Sequence
  Description of Artificial Sequence: Synthetic polypeptide
EVQLVESGGGLVQPGGSLRLSCSASGFTFSRYAMHWVRQAPGKGLEYVSAINLNGDSTYYTDSVRGRFTISRDNSKNTLFLQMSNVRPEDTAFYYCVKDGGYYDSSGPGHWGQGTLVTVSS

SEQ ID NO: 19903 - protein, 26 aa, Artificial Sequence
  Description of Artificial Sequence: Synthetic peptide
EVQLVESGGGLVQPGGSLRLSCSASG

SEQ ID NO: 19904 - protein, 9 aa, Artificial Sequence
  Description of Artificial Sequence: Synthetic peptide
FTFSRYAMH

SEQ ID NO: 19905 - protein, 14 aa, Artificial Sequence
  Description of Artificial Sequence: Synthetic peptide
WVRQAPGKGLEYVS

SEQ ID NO: 19906 - protein, 17 aa, Artificial Sequence
  Description of Artificial Sequence: Synthetic peptide
AINLNGDSTYYTDSVRG

SEQ ID NO: 19907 - protein, 30 aa, Artificial Sequence
  Description of Artificial Sequence: Synthetic polypeptide
RFTISRDNSKNTLFLQMSNVRPEDTAFYYC

SEQ ID NO: 19908 - protein, 14 aa, Artificial Sequence
  Description of Artificial Sequence: Synthetic peptide
VKDGGYYDSSGPGH

SEQ ID NO: 19909 - protein, 11 aa, Artificial Sequence
  Description of Artificial Sequence: Synthetic peptide
WGQGTLVTVSS

SEQ ID NO: 19910 - DNA, 363 bp, Artificial Sequence
  Description of Artificial Sequence: Synthetic polynucleotide
gaggtgcagctggtggagtctgggggaggcttggtccagcctggggggtccctgagactctcctgttcagcctctggatttaccttcagtagatatgcaatgcactgggtccgccaggctccagggaagggactggaatatgtttcagctattaatctcaatggcgatagcacatactacacagactccgtgaggggaagattcaccatctccagagacaactccaagaacacactgtttcttcaaatgagcaatgtgagacctgaggatacggctttttactactgtgtaaaagatgggggttactatgacagtagtggcccggggcactgggggcagggaaccctggtcaccgtctcctca

SEQ ID NO: 19911 - skipped

SEQ ID NO: 19912 - protein, 107 aa, Artificial Sequence
  Description of Artificial Sequence: Synthetic polypeptide
DIRVTQSPATLSLSPGERATLSCRASENIAHYLAWYQQKPGQAPRLVIYDASSRATGIPGRFSGSGAGTDFTLTINSLEPEDFAVYYCQQRSNWPQNFGGGTKVDIK

SEQ ID NO: 19913 - protein, 23 aa, Artificial Sequence
  Description of Artificial Sequence: Synthetic peptide
DIRVTQSPATLSLSPGERATLSC

SEQ ID NO: 19914 - protein, 11 aa, Artificial Sequence
  Description of Artificial Sequence: Synthetic peptide
RASENIAHYLA

SEQ ID NO: 19915 - protein, 15 aa, Artificial Sequence
  Description of Artificial Sequence: Synthetic peptide
WYQQKPGQAPRLVIY

SEQ ID NO: 19916 - protein, 7 aa, Artificial Sequence
  Description of Artificial Sequence: Synthetic peptide
DASSRAT

SEQ ID NO: 19917 - protein, 32 aa, Artificial Sequence; identical to SEQ ID NO: 217
  Description of Artificial Sequence: Synthetic polypeptide

SEQ ID NO: 19918 - protein, 9 aa, Artificial Sequence
  Description of Artificial Sequence: Synthetic peptide
QQRSNWPQN

SEQ ID NO: 19919 - protein, 10 aa, Artificial Sequence
  Description of Artificial Sequence: Synthetic peptide
FGGGTKVDIK

SEQ ID NO: 19920 - DNA, 321 bp, Artificial Sequence
  Description of Artificial Sequence: Synthetic polynucleotide
gacatccgggtgacccagtctcccgccaccctgtctttgtctccaggggaaagagccaccctctcctgcagggccagtgagaatattgcccactatttagcctggtaccaacagaaacctggccaggctcccaggctcgtcatctatgatgcatccagcagggccactggcatccctggcaggttcagtggcagtggggctgggacagacttcactctcaccatcaacagcctagagcctgaagattttgcagtttattactgtcagcagcgtagtaactggcctcagaacttcggcggagggaccaaagtggatatcaaa

SEQ ID NO: 19921-20001 - skipped (81 entries)

SEQ ID NO: 20002 - protein, 122 aa, Artificial Sequence
  Description of Artificial Sequence: Synthetic polypeptide
QVQLVQSGGGVVQPGGSLRLSCADSGNAFIANPMHWVRQAPGKGLEWLALISTDGNNRHYADSVKGRFTFSRDNSKNSLYLQMDSLRPEDTGVYYCARESRSSGRAGCFDSWGQGTLVTVSS

SEQ ID NO: 20003 - protein, 26 aa, Artificial Sequence
  Description of Artificial Sequence: Synthetic peptide
QVQLVQSGGGVVQPGGSLRLSCADSG

SEQ ID NO: 20004 - protein, 9 aa, Artificial Sequence
  Description of Artificial Sequence: Synthetic peptide
NAFIANPMH

SEQ ID NO: 20005 - protein, 14 aa, Artificial Sequence
  Description of Artificial Sequence: Synthetic peptide
WVRQAPGKGLEWLA

SEQ ID NO: 20006 - protein, 17 aa, Artificial Sequence
  Description of Artificial Sequence: Synthetic peptide
LISTDGNNRHYADSVKG

SEQ ID NO: 20007 - protein, 30 aa, Artificial Sequence
  Description of Artificial Sequence: Synthetic polypeptide
RFTFSRDNSKNSLYLQMDSLRPEDTGVYYC

SEQ ID NO: 20008 - protein, 15 aa, Artificial Sequence
  Description of Artificial Sequence: Synthetic peptide
ARESRSSGRAGCFDS

SEQ ID NO: 20009 - protein, 11 aa, Artificial Sequence
  Description of Artificial Sequence: Synthetic peptide
WGQGTLVTVSS

SEQ ID NO: 20010 - DNA, 366 bp, Artificial Sequence
  Description of Artificial Sequence: Synthetic polynucleotide
caggtccagcttgtgcagtctgggggaggcgtggtccagcctggggggtccctgagactctcctgtgcagactctggaaacgccttcattgccaatcctatgcactgggtccgccaggctccaggcaaggggctggagtggctggcacttatatcgactgatggaaacaataggcactacgcagactccgtgaagggccgattcaccttctccagagacaattccaaaaacagtctctatcttcaaatggacagcctgagacctgaggacacgggtgtctattactgtgcgagagagtcccgtagcagtggtcgggccgggtgctttgactcatggggccagggaaccctggtcaccgtctcttca

SEQ ID NO: 20011 - skipped

SEQ ID NO: 20012 - protein, 107 aa, Artificial Sequence
  Description of Artificial Sequence: Synthetic polypeptide
DIRLTQSPSSLSASVGDRVTITCRASQDISSWLAWYQQKSGKAPKSLIYAASSLQNGVPSRFSGSRSGTDFTLTISSLQPEDLGTYYCQQYDSYPVTFGQGTRLEIK

SEQ ID NO: 20013 - protein, 23 aa, Artificial Sequence
  Description of Artificial Sequence: Synthetic peptide
DIRLTQSPSSLSASVGDRVTITC

SEQ ID NO: 20014 - protein, 11 aa, Artificial Sequence
  Description of Artificial Sequence: Synthetic peptide
RASQDISSWLA

SEQ ID NO: 20015 - protein, 15 aa, Artificial Sequence
  Description of Artificial Sequence: Synthetic peptide
WYQQKSGKAPKSLIY

SEQ ID NO: 20016 - protein, 7 aa, Artificial Sequence
  Description of Artificial Sequence: Synthetic peptide
AASSLQN

SEQ ID NO: 20017 - protein, 32 aa, Artificial Sequence
  Description of Artificial Sequence: Synthetic polypeptide
GVPSRFSGSRSGTDFTLTISSLQPEDLGTYYC

SEQ ID NO: 20018 - protein, 9 aa, Artificial Sequence
  Description of Artificial Sequence: Synthetic peptide
QQYDSYPVT

SEQ ID NO: 20019 - protein, 10 aa, Artificial Sequence
  Description of Artificial Sequence: Synthetic peptide
FGQGTRLEIK

SEQ ID NO: 20020 - DNA, 321 bp, Artificial Sequence
  Description of Artificial Sequence: Synthetic polynucleotide
gacatccggttgacccagtctccatcctcactgtctgcatctgtaggagacagagtcaccatcacttgtcgggcgagtcaggatattagtagctggttagcctggtatcagcagaagtccgggaaagcccctaagtccctgatctatgctgcatccagtttgcaaaatggggtcccatcaagattcagtggcagtagatctgggacagatttcactctcaccatcagcagcctgcagcctgaagatttaggaacttattactgccaacagtatgatagttatccggtcaccttcggccaagggacacgactggagattaaa

SEQ ID NO: 20021-20101 - skipped (81 entries)

SEQ ID NO: 20102 - protein, 121 aa, Artificial Sequence
  Description of Artificial Sequence: Synthetic polypeptide
QVQLVESGGGVVQPGTSLRLSCAATGFTFTTYPMHWVRQAPGKGLEWVAVISYDGMNQYYADFLKGRFTISRDNSKNTLYLQMNSLRADDTAVYYCARAYGGNYQNHFDHWGQGTLVTVSS

SEQ ID NO: 20103 - protein, 26 aa, Artificial Sequence
  Description of Artificial Sequence: Synthetic peptide
QVQLVESGGGVVQPGTSLRLSCAATG

SEQ ID NO: 20104 - protein, 9 aa, Artificial Sequence
  Description of Artificial Sequence: Synthetic peptide
FTFTTYPMH

SEQ ID NO: 20105 - protein, 14 aa, Artificial Sequence
  Description of Artificial Sequence: Synthetic peptide
WVRQAPGKGLEWVA

SEQ ID NO: 20106 - protein, 17 aa, Artificial Sequence
  Description of Artificial Sequence: Synthetic peptide
VISYDGMNQYYADFLKG

SEQ ID NO: 20107 - protein, 30 aa, Artificial Sequence; identical to SEQ ID NO: 2407
  Description of Artificial Sequence: Synthetic polypeptide

SEQ ID NO: 20108 - protein, 14 aa, Artificial Sequence
  Description of Artificial Sequence: Synthetic peptide
ARAYGGNYQNHFDH

SEQ ID NO: 20109 - protein, 11 aa, Artificial Sequence
  Description of Artificial Sequence: Synthetic peptide
WGQGTLVTVSS

SEQ ID NO: 20110 - DNA, 363 bp, Artificial Sequence
  Description of Artificial Sequence: Synthetic polynucleotide
caggtgcagctggtggagtctgggggaggcgtggtccagcctgggacgtccctgagactctcctgtgcagccactggattcaccttcactacctaccctatgcactgggtccgccaggctccaggcaaggggctggagtgggtggccgttatatcatatgatggaatgaatcaatactacgcagacttcctgaagggccgattcaccatctccagagacaattccaagaacacgttgtatctgcagatgaacagcctgagagctgacgacacggctgtgtattactgtgcgagagcttatggtggaaattaccaaaaccacttcgaccactggggccagggaaccctggtcaccgtctcctca

SEQ ID NO: 20111 - skipped

SEQ ID NO: 20112 - protein, 112 aa, Artificial Sequence
  Description of Artificial Sequence: Synthetic polypeptide
DIVLTQTPDSLAVSLGERATINCKSSQSVLYSSNNKNYLAWYQQKPGQPPKLLIYWASTRESGVPDRFSGSGSGTDFTLTISSLQAEDVAVYYCQQYYTMWTFGQGTKVEIK

SEQ ID NO: 20113 - protein, 23 aa, Artificial Sequence
  Description of Artificial Sequence: Synthetic peptide
DIVLTQTPDSLAVSLGERATINC

SEQ ID NO: 20114 - protein, 17 aa, Artificial Sequence
  Description of Artificial Sequence: Synthetic peptide
KSSQSVLYSSNNKNYLA

SEQ ID NO: 20115 - protein, 15 aa, Artificial Sequence
  Description of Artificial Sequence: Synthetic peptide
WYQQKPGQPPKLLIY

SEQ ID NO: 20116 - protein, 7 aa, Artificial Sequence
  Description of Artificial Sequence: Synthetic peptide
WASTRES

SEQ ID NO: 20117 - protein, 32 aa, Artificial Sequence; identical to SEQ ID NO: 1617
  Description of Artificial Sequence: Synthetic polypeptide

SEQ ID NO: 20118 - protein, 8 aa, Artificial Sequence
  Description of Artificial Sequence: Synthetic peptide
QQYYTMWT

SEQ ID NO: 20119 - protein, 10 aa, Artificial Sequence
  Description of Artificial Sequence: Synthetic peptide
FGQGTKVEIK

SEQ ID NO: 20120 - DNA, 336 bp, Artificial Sequence
  Description of Artificial Sequence: Synthetic polynucleotide
gatattgtgctgactcagactccagactccctggctgtgtctctgggcgagagggccaccatcaactgcaagtccagccagagtgttttatacagctccaacaataagaactacttagcttggtaccaacagaaaccaggtcagcctcctaagttgctcatttactgggcatctacccgggaatccggggtccctgaccgattcagtggcagcgggtctgggacagatttcactctcaccatcagcagcctgcaggctgaagatgtggcagtttattactgtcagcaatattatactatgtggacattcggccaagggaccaaggtggaaatcaaa

SEQ ID NO: 20121-20201 - skipped (81 entries)

SEQ ID NO: 20202 - protein, 132 aa, Artificial Sequence
  Description of Artificial Sequence: Synthetic polypeptide
EVQLVQWGAGLLKPSETLSLRCAVYGGSFNGFYWTWIRQAPGQGLEWIAEINHSGTTNYNPSLKSRVTISIDTSKKQFSLSLKSVTAADTAMYFCARGTISPIVGVPTPVVPRRGRSWFDPWGQGTLVTVSS

SEQ ID NO: 20203 - protein, 26 aa, Artificial Sequence
  Description of Artificial Sequence: Synthetic peptide
EVQLVQWGAGLLKPSETLSLRCAVYG

SEQ ID NO: 20204 - protein, 9 aa, Artificial Sequence
  Description of Artificial Sequence: Synthetic peptide
GSFNGFYWT

SEQ ID NO: 20205 - protein, 14 aa, Artificial Sequence
  Description of Artificial Sequence: Synthetic peptide
WIRQAPGQGLEWIA

SEQ ID NO: 20206 - protein, 16 aa, Artificial Sequence
  Description of Artificial Sequence: Synthetic peptide
EINHSGTTNYNPSLKS

SEQ ID NO: 20207 - protein, 30 aa, Artificial Sequence
  Description of Artificial Sequence: Synthetic polypeptide
RVTISIDTSKKQFSLSLKSVTAADTAMYFC

SEQ ID NO: 20208 - protein, 26 aa, Artificial Sequence
  Description of Artificial Sequence: Synthetic peptide
ARGTISPIVGVPTPVVPRRGRSWFDP

SEQ ID NO: 20209 - protein, 11 aa, Artificial Sequence
  Description of Artificial Sequence: Synthetic peptide
WGQGTLVTVSS

SEQ ID NO: 20210 - DNA, 396 bp, Artificial Sequence
  Description of Artificial Sequence: Synthetic polynucleotide
gaggtgcagctggtgcagtggggcgcaggactgttgaagccgtcggagaccctgtccctcagatgcgctgtctatggtgggtctttcaatggtttctactggacctggattcgtcaggcccccggacaggggctggagtggattgcggagatcaatcatagtggaaccaccaactataacccgtccctcaagagtcgggtcaccatttctatagacacgtccaagaagcagttctccctgagtctgaagtctgtgaccgccgcggacacggctatgtatttttgtgcgagaggcacaatttcccccattgtaggagtaccaactcctgtggtgccccgccgggggaggagctggttcgacccctggggccagggaaccctggtcaccgtctcctca

SEQ ID NO: 20211 - skipped

SEQ ID NO: 20212 - protein, 112 aa, Artificial Sequence
  Description of Artificial Sequence: Synthetic polypeptide
QSVLTQPPSVSAAPGQKVTISCSGSSSNIGNDYVSWYQQLPGTAPKLLIYENYKRPSGIPDRFSGSKSGTSATLDITGLQTGDEADYYCGTWDSSLSVDNYVFGTGTKLTVL

SEQ ID NO: 20213 - protein, 22 aa, Artificial Sequence
  Description of Artificial Sequence: Synthetic peptide
QSVLTQPPSVSAAPGQKVTISC

SEQ ID NO: 20214 - protein, 13 aa, Artificial Sequence
  Description of Artificial Sequence: Synthetic peptide
SGSSSNIGNDYVS

SEQ ID NO: 20215 - protein, 15 aa, Artificial Sequence
  Description of Artificial Sequence: Synthetic peptide
WYQQLPGTAPKLLIY

SEQ ID NO: 20216 - protein, 7 aa, Artificial Sequence
  Description of Artificial Sequence: Synthetic peptide
ENYKRPS

SEQ ID NO: 20217 - protein, 32 aa, Artificial Sequence
  Description of Artificial Sequence: Synthetic polypeptide
GIPDRFSGSKSGTSATLDITGLQTGDEADYYC

SEQ ID NO: 20218 - protein, 13 aa, Artificial Sequence
  Description of Artificial Sequence: Synthetic peptide
GTWDSSLSVDNYV

SEQ ID NO: 20219 - protein, 10 aa, Artificial Sequence
  Description of Artificial Sequence: Synthetic peptide
FGTGTKLTVL

SEQ ID NO: 20220 - DNA, 336 bp, Artificial Sequence
  Description of Artificial Sequence: Synthetic polynucleotide
cagtctgtcttgacgcagccgccctcagtgtctgcggccccaggacagaaggtcaccatctcctgctctggaagcagctccaacattggcaatgattatgtatcctggtaccagcaactcccaggaacagcccccaaactcctcatttatgaaaactataagcgaccctcagggattcctgaccgattctctggctccaagtctggcacgtcagccaccctggacatcaccggactccagactggggacgaggccgattattactgcggaacatgggatagcagcctgagtgttgacaattatgtcttcgggactgggaccaagctcaccgtccta

SEQ ID NO: 20221-20301 - skipped (81 entries)

SEQ ID NO: 20302 - protein, 129 aa, Artificial Sequence
  Description of Artificial Sequence: Synthetic polypeptide
QVQLVQSGAEVKKPGSSVKVSCKASGGTFSTHAISWVRQAPGHGPEWLGGIIPLFGTSESAQRFQARVKITADESTSTAYMELSSLTSEDTAVYYCVRDSDPYTATSRNNHYWYAMDVWGQGTTVTVSS

SEQ ID NO: 20303 - protein, 26 aa, Artificial Sequence
  Description of Artificial Sequence: Synthetic peptide
QVQLVQSGAEVKKPGSSVKVSCKASG

SEQ ID NO: 20304 - protein, 9 aa, Artificial Sequence
  Description of Artificial Sequence: Synthetic peptide
GTFSTHAIS

SEQ ID NO: 20305 - protein, 14 aa, Artificial Sequence
  Description of Artificial Sequence: Synthetic peptide
WVRQAPGHGPEWLG

SEQ ID NO: 20306 - protein, 17 aa, Artificial Sequence
  Description of Artificial Sequence: Synthetic peptide
GIIPLFGTSESAQRFQA

SEQ ID NO: 20307 - protein, 30 aa, Artificial Sequence; identical to SEQ ID NO: 5907
  Description of Artificial Sequence: Synthetic polypeptide

SEQ ID NO: 20308 - protein, 22 aa, Artificial Sequence
  Description of Artificial Sequence: Synthetic peptide
VRDSDPYTATSRNNHYWYAMDV

SEQ ID NO: 20309 - protein, 11 aa, Artificial Sequence
  Description of Artificial Sequence: Synthetic peptide
WGQGTTVTVSS

SEQ ID NO: 20310 - DNA, 387 bp, Artificial Sequence
  Description of Artificial Sequence: Synthetic polynucleotide
caggtccagctggtgcagtctggggctgaggtgaagaagcctgggtcctcggtgaaggtctcctgcaaggcttctggaggcaccttcagcacccatgctatcagctgggtgcgacaggcccctggacatgggcctgagtggctgggagggatcatccctctttttggtacatcagaatccgcacagaggttccaggccagagtcaagattaccgcggacgaatccacgagcacagcctacatggagctgagcagcctgacatctgaagacacggccgtttattactgtgtgagagactctgacccctatacggcgactagcaggaataatcactactggtatgctatggacgtctggggccaagggaccacggtcaccgtctcttca

SEQ ID NO: 20311 - skipped

SEQ ID NO: 20312 - protein, 112 aa, Artificial Sequence
  Description of Artificial Sequence: Synthetic polypeptide
DIVLTQSPLSLPVTLGQPASISCRSSQSVVHSDGNTYLNWFHQRPGQSPRRLIYKVSNRDSGVPDRFSGSGSGTDFTLKISRVEAEDIGVYYCMQGTDWPRTFGQGTKVDIK

SEQ ID NO: 20313 - protein, 23 aa, Artificial Sequence
  Description of Artificial Sequence: Synthetic peptide
DIVLTQSPLSLPVTLGQPASISC

SEQ ID NO: 20314 - protein, 16 aa, Artificial Sequence
  Description of Artificial Sequence: Synthetic peptide
RSSQSVVHSDGNTYLN

SEQ ID NO: 20315 - protein, 15 aa, Artificial Sequence
  Description of Artificial Sequence: Synthetic peptide
WFHQRPGQSPRRLIY

SEQ ID NO: 20316 - protein, 7 aa, Artificial Sequence
  Description of Artificial Sequence: Synthetic peptide
KVSNRDS

SEQ ID NO: 20317 - protein, 32 aa, Artificial Sequence; identical to SEQ ID NO: 1317
  Description of Artificial Sequence: Synthetic polypeptide

SEQ ID NO: 20318 - protein, 9 aa, Artificial Sequence
  Description of Artificial Sequence: Synthetic peptide
MQGTDWPRT

SEQ ID NO: 20319 - protein, 10 aa, Artificial Sequence
  Description of Artificial Sequence: Synthetic peptide
FGQGTKVDIK

SEQ ID NO: 20320 - DNA, 336 bp, Artificial Sequence
  Description of Artificial Sequence: Synthetic polynucleotide
gatattgtgctgactcagtctccactctccctgcccgtcacccttggacagccggcctccatctcctgcaggtctagtcaaagcgtcgtacacagtgatggaaacacctacttgaattggtttcaccagaggccaggccaatctccaaggcgcctaatttataaggtttctaatcgggactctggggtcccagacagattcagcggcagtgggtcaggcactgacttcacactgaaaatcagcagggtggaggctgaagatattggggtttattactgcatgcaaggtacagactggcctcggacttttggccaggggaccaaagtggatatcaaa

SEQ ID NO: 20321-20401 - skipped (81 entries)

SEQ ID NO: 20402 - protein, 129 aa, Artificial Sequence
  Description of Artificial Sequence: Synthetic polypeptide
QVQLVQSGAEVREPGSSVKLSCKTSGGPFSTHAFSWVRQAPGQRPEWMGGIMPVFGESKDTQKFKGRVTFTADASTTTTYMELRSLKSDDTAIYYCVRDSDPYTATSSHNHYWYAMDVWGQGTTVTVSS

SEQ ID NO: 20403 - protein, 26 aa, Artificial Sequence
  Description of Artificial Sequence: Synthetic peptide
QVQLVQSGAEVREPGSSVKLSCKTSG

SEQ ID NO: 20404 - protein, 9 aa, Artificial Sequence
  Description of Artificial Sequence: Synthetic peptide
GPFSTHAFS

SEQ ID NO: 20405 - protein, 14 aa, Artificial Sequence
  Description of Artificial Sequence: Synthetic peptide
WVRQAPGQRPEWMG

SEQ ID NO: 20406 - protein, 17 aa, Artificial Sequence
  Description of Artificial Sequence: Synthetic peptide
GIMPVFGESKDTQKFKG

SEQ ID NO: 20407 - protein, 30 aa, Artificial Sequence
  Description of Artificial Sequence: Synthetic polypeptide
RVTFTADASTTTTYMELRSLKSDDTAIYYC

SEQ ID NO: 20408 - protein, 22 aa, Artificial Sequence
  Description of Artificial Sequence: Synthetic peptide
VRDSDPYTATSSHNHYWYAMDV

SEQ ID NO: 20409 - protein, 11 aa, Artificial Sequence
  Description of Artificial Sequence: Synthetic peptide
WGQGTTVTVSS

SEQ ID NO: 20410 - DNA, 387 bp, Artificial Sequence
  Description of Artificial Sequence: Synthetic polynucleotide
caggtccagctggtgcagtctggggctgaggtgagggagcctgggtcctcggtgaagctctcctgcaagacttctggaggccccttcagcactcatgctttcagttgggtgcggcaggcccctggacaacggcctgagtggatgggagggatcatgcctgtttttggtgagtcaaaagacacacagaagtttaaaggcagagtcacctttaccgcggacgcttccacgactaccacctacatggagttgaggagcctaaaatctgacgacacggccatatattactgtgtgagagactcagacccctacacggcgacctctagtcacaatcactattggtatgctatggacgtctggggccaggggaccacggtcactgtctcctca

SEQ ID NO: 20411 - skipped

SEQ ID NO: 20412 - protein, 112 aa, Artificial Sequence
  Description of Artificial Sequence: Synthetic polypeptide
ETTLTQSPLSLPVTLGQPASISCRSSQVLVHSDGNTYLNWFQQRPGQSPRRLIYKVSNRDSGVPDRFSGSGSGIDFTLKISRVEAEDIGVYYCMQGTEWPRTFGQGTKVDIK

SEQ ID NO: 20413 - protein, 23 aa, Artificial Sequence
  Description of Artificial Sequence: Synthetic peptide
ETTLTQSPLSLPVTLGQPASISC

SEQ ID NO: 20414 - protein, 16 aa, Artificial Sequence
  Description of Artificial Sequence: Synthetic peptide
RSSQVLVHSDGNTYLN

SEQ ID NO: 20415 - protein, 15 aa, Artificial Sequence
  Description of Artificial Sequence: Synthetic peptide
WFQQRPGQSPRRLIY

SEQ ID NO: 20416 - protein, 7 aa, Artificial Sequence
  Description of Artificial Sequence: Synthetic peptide
KVSNRDS

SEQ ID NO: 20417 - protein, 32 aa, Artificial Sequence; identical to SEQ ID NO: 2517
  Description of Artificial Sequence: Synthetic polypeptide

SEQ ID NO: 20418 - protein, 9 aa, Artificial Sequence
  Description of Artificial Sequence: Synthetic peptide
MQGTEWPRT

SEQ ID NO: 20419 - protein, 10 aa, Artificial Sequence
  Description of Artificial Sequence: Synthetic peptide
FGQGTKVDIK

SEQ ID NO: 20420 - DNA, 336 bp, Artificial Sequence
  Description of Artificial Sequence: Synthetic polynucleotide
gaaacgacactcacgcagtctccactctccctgcccgtcacccttggacagccggcctccatctcctgcaggtctagtcaagtcctcgttcacagtgatggaaacacctacttgaattggtttcagcagaggccaggccaatctccaaggcgcctcatttataaggtttctaaccgggactctggggtcccagacagattcagcggcagtgggtcaggcattgacttcacactgaaaatcagcagggtggaggctgaggacattggagtttattactgcatgcaaggtacagagtggcctcggacttttggccaggggaccaaagtggatatcaaa

SEQ ID NO: 20421-20501 - skipped (81 entries)

SEQ ID NO: 20502 - protein, 118 aa, Artificial Sequence
  Description of Artificial Sequence: Synthetic polypeptide
QVQLVESGGGLVKPGGSLRLSCAASGFTFSDYYMIWIRQAPGKGLEWLSYISHTASTIYYADSVKGRFTISRDNAKNSLFLQMNSLTAEDTAVYYCARDRGSGVIDPWGQGTLVTVSS

SEQ ID NO: 20503 - protein, 26 aa, Artificial Sequence
  Description of Artificial Sequence: Synthetic peptide
QVQLVESGGGLVKPGGSLRLSCAASG

SEQ ID NO: 20504 - protein, 9 aa, Artificial Sequence
  Description of Artificial Sequence: Synthetic peptide
FTFSDYYMI

SEQ ID NO: 20505 - protein, 14 aa, Artificial Sequence
  Description of Artificial Sequence: Synthetic peptide
WIRQAPGKGLEWLS

SEQ ID NO: 20506 - protein, 17 aa, Artificial Sequence
  Description of Artificial Sequence: Synthetic peptide
YISHTASTIYYADSVKG

SEQ ID NO: 20507 - protein, 30 aa, Artificial Sequence
  Description of Artificial Sequence: Synthetic polypeptide
RFTISRDNAKNSLFLQMNSLTAEDTAVYYC

SEQ ID NO: 20508 - protein, 11 aa, Artificial Sequence
  Description of Artificial Sequence: Synthetic peptide
ARDRGSGVIDP

SEQ ID NO: 20509 - protein, 11 aa, Artificial Sequence
  Description of Artificial Sequence: Synthetic peptide
WGQGTLVTVSS

SEQ ID NO: 20510 - DNA, 354 bp, Artificial Sequence
  Description of Artificial Sequence: Synthetic polynucleotide
caggtgcagctggtggagtctgggggaggcttggtcaagcctggagggtccctgagactctcctgtgcagcctcaggattcaccttcagtgactactacatgatctggatccgccaggctccagggaaggggctggagtggctttcatacattagtcatactgctagtaccatatactacgcagactctgtgaagggccgattcaccatctccagggacaacgccaagaactcactgtttctgcaaatgaacagcctgacagccgaggacacggccgtgtattactgtgcgagagatcgaggtagcggagtcatcgacccctggggccagggaaccctggtcactgtctcctca

SEQ ID NO: 20511 - skipped

SEQ ID NO: 20512 - protein, 107 aa, Artificial Sequence
  Description of Artificial Sequence: Synthetic polypeptide
DIQLTQSPSSLSASVGDRVTITCRASQSISHYLNWYQQKPGKAPKLLIYAASNLQSGVPSRFSGNGSGTDFTLTISSLQPEDFATYFCQQSYSTPLTFGGGTKVDIK

SEQ ID NO: 20513 - protein, 23 aa, Artificial Sequence
  Description of Artificial Sequence: Synthetic peptide
DIQLTQSPSSLSASVGDRVTITC

SEQ ID NO: 20514 - protein, 11 aa, Artificial Sequence
  Description of Artificial Sequence: Synthetic peptide
RASQSISHYLN

SEQ ID NO: 20515 - protein, 15 aa, Artificial Sequence
  Description of Artificial Sequence: Synthetic peptide
WYQQKPGKAPKLLIY

SEQ ID NO: 20516 - protein, 7 aa, Artificial Sequence
  Description of Artificial Sequence: Synthetic peptide
AASNLQS

SEQ ID NO: 20517 - protein, 32 aa, Artificial Sequence
  Description of Artificial Sequence: Synthetic polypeptide
GVPSRFSGNGSGTDFTLTISSLQPEDFATYFC

SEQ ID NO: 20518 - protein, 9 aa, Artificial Sequence
  Description of Artificial Sequence: Synthetic peptide
QQSYSTPLT

SEQ ID NO: 20519 - protein, 10 aa, Artificial Sequence
  Description of Artificial Sequence: Synthetic peptide
FGGGTKVDIK

SEQ ID NO: 20520 - DNA, 321 bp, Artificial Sequence
  Description of Artificial Sequence: Synthetic polynucleotide
gacatccagttgacccagtctccatcctccctgtctgcatctgtaggtgacagagtcaccatcacttgccgggcaagtcagagtattagtcactatttaaattggtatcagcagaaaccagggaaagcccctaagctcctaatctatgctgcatccaatttgcaaagtggggtcccatcaaggttcagtggcaatggatctgggacagatttcactctcaccatcagcagtctgcaacctgaagattttgcaacttacttctgtcaacagagttacagtacccccctcactttcggcggagggaccaaagtggatatcaaa

SEQ ID NO: 20521-20601 - skipped (81 entries)

SEQ ID NO: 20602 - protein, 123 aa, Artificial Sequence
  Description of Artificial Sequence: Synthetic polypeptide
QVQLVESGGGLSQPGGSLRLSCATSGFAVRNNCMNWVRQAPGKGLEWVSLICGDGITYHSDSVKGRFIISRDDSENALHLQMNSLRVEDTAVYYCVKASPPGGNTGWPFFHYWGQGTLVTVSS

SEQ ID NO: 20603 - protein, 26 aa, Artificial Sequence
  Description of Artificial Sequence: Synthetic peptide
QVQLVESGGGLSQPGGSLRLSCATSG

SEQ ID NO: 20604 - protein, 9 aa, Artificial Sequence
  Description of Artificial Sequence: Synthetic peptide
FAVRNNCMN

SEQ ID NO: 20605 - protein, 14 aa, Artificial Sequence
  Description of Artificial Sequence: Synthetic peptide
WVRQAPGKGLEWVS

SEQ ID NO: 20606 - protein, 16 aa, Artificial Sequence
  Description of Artificial Sequence: Synthetic peptide
LICGDGITYHSDSVKG

SEQ ID NO: 20607 - protein, 30 aa, Artificial Sequence
  Description of Artificial Sequence: Synthetic polypeptide
RFIISRDDSENALHLQMNSLRVEDTAVYYC

SEQ ID NO: 20608 - protein, 17 aa, Artificial Sequence
  Description of Artificial Sequence: Synthetic peptide
VKASPPGGNTGWPFFHY

SEQ ID NO: 20609 - protein, 11 aa, Artificial Sequence
  Description of Artificial Sequence: Synthetic peptide
WGQGTLVTVSS

SEQ ID NO: 20610 - DNA, 369 bp, Artificial Sequence
  Description of Artificial Sequence: Synthetic polynucleotide
caggtgcagctggtggagtccggagggggcttgagccagcctggggggtccctgaggctctcctgtgcaacgtctggtttcgccgtcagaaacaactgcatgaactgggtccgccaggctccagggaaggggctggagtgggtctcccttatttgtggcgatggtatcacatatcactcagactccgtgaagggccgattcatcatttccagagacgactctgaaaatgcactgcatcttcaaatgaacagcctcagagtcgaggacacggccgtctattattgtgtgaaagcgtcgccccccgggggtaacactggctggcccttctttcattactggggccagggcaccctggtcaccgtctcctca

SEQ ID NO: 20611 - skipped

SEQ ID NO: 20612 - protein, 108 aa, Artificial Sequence
  Description of Artificial Sequence: Synthetic polypeptide
ETTLTQSPAILSVSPGEGATLSCRASQSVRSNLAWFQQRPGQVPRLLIYDASNRATGVPARFSGSGFGTEFTLTISSLQSEDFAVYYCQQYNNWPPLTFGGGTKVDIK

SEQ ID NO: 20613 - protein, 23 aa, Artificial Sequence
  Description of Artificial Sequence: Synthetic peptide
ETTLTQSPAILSVSPGEGATLSC

SEQ ID NO: 20614 - protein, 11 aa, Artificial Sequence
  Description of Artificial Sequence: Synthetic peptide
RASQSVRSNLA

SEQ ID NO: 20615 - protein, 15 aa, Artificial Sequence
  Description of Artificial Sequence: Synthetic peptide
WFQQRPGQVPRLLIY

SEQ ID NO: 20616 - protein, 7 aa, Artificial Sequence
  Description of Artificial Sequence: Synthetic peptide
DASNRAT

SEQ ID NO: 20617 - protein, 32 aa, Artificial Sequence
  Description of Artificial Sequence: Synthetic polypeptide
GVPARFSGSGFGTEFTLTISSLQSEDFAVYYC

SEQ ID NO: 20618 - protein, 10 aa, Artificial Sequence
  Description of Artificial Sequence: Synthetic peptide
QQYNNWPPLT

SEQ ID NO: 20619 - protein, 10 aa, Artificial Sequence
  Description of Artificial Sequence: Synthetic peptide
FGGGTKVDIK

SEQ ID NO: 20620 - DNA, 324 bp, Artificial Sequence
  Description of Artificial Sequence: Synthetic polynucleotide
gaaacgacactcacgcagtctccagccattctgtctgtgtctccaggggaaggagccaccctctcctgcagggccagtcagagtgttagaagcaacttagcctggttccagcagagacctggccaggttcccaggctcctcatctatgatgcatccaacagggccactggtgtcccagccaggttcagtggcagtgggtttgggacagagttcactctcaccatcagcagcctgcagtctgaagattttgcagtttattattgtcaacagtataataactggcctcctctcactttcggcggcgggaccaaagtggatatcaaa

SEQ ID NO: 20621-20701 - skipped (81 entries)

SEQ ID NO: 20702 - protein, 120 aa, Artificial Sequence
  Description of Artificial Sequence: Synthetic polypeptide
EVQLVESGGGVVNPGGSLRLSCAGSGFTFSDYYMGWIRQAPGKGLEVVSYISTTGSYIKDADSVKGRFTISRDNAKNSVYLQMNSLRAEDTAVYYCARMGPYGSGSFDYWGQGTLVTVSS

SEQ ID NO: 20703 - protein, 26 aa, Artificial Sequence
  Description of Artificial Sequence: Synthetic peptide
EVQLVESGGGVVNPGGSLRLSCAGSG

SEQ ID NO: 20704 - protein, 9 aa, Artificial Sequence
  Description of Artificial Sequence: Synthetic peptide
FTFSDYYMG

SEQ ID NO: 20705 - protein, 14 aa, Artificial Sequence
  Description of Artificial Sequence: Synthetic peptide
WIRQAPGKGLEVVS

SEQ ID NO: 20706 - protein, 17 aa, Artificial Sequence
  Description of Artificial Sequence: Synthetic peptide
YISTTGSYIKDADSVKG

SEQ ID NO: 20707 - protein, 30 aa, Artificial Sequence; identical to SEQ ID NO: 6407
  Description of Artificial Sequence: Synthetic polypeptide

SEQ ID NO: 20708 - protein, 13 aa, Artificial Sequence
  Description of Artificial Sequence: Synthetic peptide
ARMGPYGSGSFDY

SEQ ID NO: 20709 - protein, 11 aa, Artificial Sequence
  Description of Artificial Sequence: Synthetic peptide
WGQGTLVTVSS

SEQ ID NO: 20710 - DNA, 360 bp, Artificial Sequence
  Description of Artificial Sequence: Synthetic polynucleotide
gaggtgcagctggtggagtctgggggaggcgtggtcaaccctggagggtccctgagactctcctgtgcaggctctggattcactttcagtgactactacatgggttggatccgccaggctccagggaaggggctggaggtggtttcatacattagtactactgggtcctatataaaggacgcagactctgtgaagggccgattcaccatctcccgagacaacgccaagaattcagtgtatctgcaaatgaacagcctgagagccgaagacacggctgtctattactgtgcgagaatgggcccctatggttcggggagctttgactactggggccagggaaccctggtcaccgtctcctca

SEQ ID NO: 20711 - skipped

SEQ ID NO: 20712 - protein, 107 aa, Artificial Sequence
  Description of Artificial Sequence: Synthetic polypeptide
EIVMTQSPGTLSLSPGERATLSCRASQTVTRSQLAWYQHKPGQPPRLLIYDSSNRATGTPDRFSASGSGTEFTLTITRLEPEDSAVYYCLQYSSATTFGPGTKVDIK

SEQ ID NO: 20713 - protein, 23 aa, Artificial Sequence
  Description of Artificial Sequence: Synthetic peptide
EIVMTQSPGTLSLSPGERATLSC

SEQ ID NO: 20714 - protein, 12 aa, Artificial Sequence
  Description of Artificial Sequence: Synthetic peptide
RASQTVTRSQLA

SEQ ID NO: 20715 - protein, 15 aa, Artificial Sequence
  Description of Artificial Sequence: Synthetic peptide
WYQHKPGQPPRLLIY

SEQ ID NO: 20716 - protein, 7 aa, Artificial Sequence
  Description of Artificial Sequence: Synthetic peptide
DSSNRAT

SEQ ID NO: 20717 - protein, 32 aa, Artificial Sequence
  Description of Artificial Sequence: Synthetic polypeptide
GTPDRFSASGSGTEFTLTITRLEPEDSAVYYC

SEQ ID NO: 20718 - protein, 8 aa, Artificial Sequence
  Description of Artificial Sequence: Synthetic peptide
LQYSSATT

SEQ ID NO: 20719 - protein, 10 aa, Artificial Sequence
  Description of Artificial Sequence: Synthetic peptide
FGPGTKVDIK

SEQ ID NO: 20720 - DNA, 321 bp, Artificial Sequence
  Description of Artificial Sequence: Synthetic polynucleotide
gaaattgtaatgacacagtctccaggcaccctgtctttgtctccaggggaaagagccaccctctcctgcagggccagtcagactgttactagaagccagttagcctggtaccagcacaaacctggccagcctcccaggctcctcatctatgattcatccaacagggccactggcaccccagacaggttcagtgccagtgggtctgggactgagttcactctcactatcactagattggagcctgaagattctgcggtttattattgtctccagtatagtagcgcaacgacgttcggcccagggaccaaagtggatatcaaa

SEQ ID NO: 20721-20801 - skipped (81 entries)

SEQ ID NO: 20802 - protein, 128 aa, Artificial Sequence
  Description of Artificial Sequence: Synthetic polypeptide
QVQLQESGPGLVKPSETLSLTCTVSGGSVSDTPFYWGWIRQPPGKGLEWIGSMYYTGSTYYNPSLKSRVTISVDTSKNQFSLKLSSVTAADTAVYYCARHPSSIFRGTVFTPYYFDYWGQGTLVTVSS

SEQ ID NO: 20803 - protein, 26 aa, Artificial Sequence
  Description of Artificial Sequence: Synthetic peptide
QVQLQESGPGLVKPSETLSLTCTVSG

SEQ ID NO: 20804 - protein, 11 aa, Artificial Sequence
  Description of Artificial Sequence: Synthetic peptide
GSVSDTPFYWG

SEQ ID NO: 20805 - protein, 14 aa, Artificial Sequence
  Description of Artificial Sequence: Synthetic peptide
WIRQPPGKGLEWIG

SEQ ID NO: 20806 - protein, 16 aa, Artificial Sequence
  Description of Artificial Sequence: Synthetic peptide
SMYYTGSTYYNPSLKS

SEQ ID NO: 20807 - protein, 30 aa, Artificial Sequence; identical to SEQ ID NO: 8407
  Description of Artificial Sequence: Synthetic polypeptide

SEQ ID NO: 20808 - protein, 20 aa, Artificial Sequence
  Description of Artificial Sequence: Synthetic peptide
ARHPSSIFRGTVFTPYYFDY

SEQ ID NO: 20809 - protein, 11 aa, Artificial Sequence
  Description of Artificial Sequence: Synthetic peptide
WGQGTLVTVSS

SEQ ID NO: 20810 - DNA, 384 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccgtcagcgatactcctttctactggggctggatccgccagcccccagggaaggggctggagtggattgggagtatgtactatactgggagcacctactacaacccgtccctcaagagtcgagtcacaatatccgtagacacgtccaagaaccagttctccctgaagctgagctctgtgaccgccgcagacacggctgtctattactgtgcgagacaccccagctctatatttcggggaactgtttttaccccttactactttgactactggggccagggaaccctggtcaccgtctcttca

SEQ ID NO: 20811 - skipped

SEQ ID NO: 20812 - protein, 109 aa, Artificial Sequence
  Description of Artificial Sequence: Synthetic polypeptide
ETTLTQSPGTLSLSPGERATLSCRASQSVTSNYLAWYQQKPGQAPRLLIYGASSRATGIPDRFSGSGSGTDFTLTISRLEPEDFAVYYCQQYGRAPLYTFGLGTKVDIK

SEQ ID NO: 20813 - protein, 23 aa, Artificial Sequence
  Description of Artificial Sequence: Synthetic peptide
ETTLTQSPGTLSLSPGERATLSC

SEQ ID NO: 20814 - protein, 12 aa, Artificial Sequence
  Description of Artificial Sequence: Synthetic peptide
RASQSVTSNYLA

SEQ ID NO: 20815 - protein, 15 aa, Artificial Sequence
  Description of Artificial Sequence: Synthetic peptide
WYQQKPGQAPRLLIY

SEQ ID NO: 20816 - protein, 7 aa, Artificial Sequence
  Description of Artificial Sequence: Synthetic peptide
GASSRAT

SEQ ID NO: 20817 - protein, 32 aa, Artificial Sequence; identical to SEQ ID NO: 2917
  Description of Artificial Sequence: Synthetic polypeptide

SEQ ID NO: 20818 - protein, 10 aa, Artificial Sequence
  Description of Artificial Sequence: Synthetic peptide
QQYGRAPLYT

SEQ ID NO: 20819 - protein, 10 aa, Artificial Sequence
  Description of Artificial Sequence: Synthetic peptide
FGLGTKVDIK

SEQ ID NO: 20820 - DNA, 327 bp, Artificial Sequence
  Description of Artificial Sequence: Synthetic polynucleotide
gaaacgacactcacgcagtctccaggcaccctgtctttgtctccaggggaaagagccaccctctcctgcagggccagtcagagtgttaccagcaactacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagggcacctctgtacacttttggcctggggaccaaagtggatatcaaa

SEQ ID NO: 20821-20901 - skipped (81 entries)

SEQ ID NO: 20902 - protein, 122 aa, Artificial Sequence
  Description of Artificial Sequence: Synthetic polypeptide
QVQLVESGGGLVQPGGSLRLSCTASTFTFSNYWMAWVRQAPGKGLEWVANIKQDGSEKYYVDSVKGRFTISRDNTKNSLYLQMNSLRAEDTAVYYCARGSRVHTSNWAFDYWGQGTTVTVSS

SEQ ID NO: 20903 - protein, 26 aa, Artificial Sequence
  Description of Artificial Sequence: Synthetic peptide
QVQLVESGGGLVQPGGSLRLSCTAST

SEQ ID NO: 20904 - protein, 9 aa, Artificial Sequence
  Description of Artificial Sequence: Synthetic peptide
FTFSNYWMA

SEQ ID NO: 20905 - protein, 14 aa, Artificial Sequence
  Description of Artificial Sequence: Synthetic peptide
WVRQAPGKGLEWVA

SEQ ID NO: 20906 - protein, 17 aa, Artificial Sequence
  Description of Artificial Sequence: Synthetic peptide
NIKQDGSEKYYVDSVKG

SEQ ID NO: 20907 - protein, 30 aa, Artificial Sequence
  Description of Artificial Sequence: Synthetic polypeptide
RFTISRDNTKNSLYLQMNSLRAEDTAVYYC

SEQ ID NO: 20908 - protein, 15 aa, Artificial Sequence
  Description of Artificial Sequence: Synthetic peptide
ARGSRVHTSNWAFDY

SEQ ID NO: 20909 - protein, 11 aa, Artificial Sequence
  Description of Artificial Sequence: Synthetic peptide
WGQGTTVTVSS

SEQ ID NO: 20910 - DNA, 366 bp, Artificial Sequence
  Description of Artificial Sequence: Synthetic polynucleotide
caggtgcagctggtggagtctgggggaggcttggtccagcctggggggtccctgagactctcctgtacagcctctacattcacctttagtaactattggatggcctgggtccgccaggctccagggaaggggctggagtgggtggccaacataaagcaagatggaagtgagaaatactatgtagactctgtgaagggccgattcaccatctccagagacaacaccaagaactcactgtatctgcaaatgaacagcctgagagccgaggacacggccgtctattactgtgcgagagggtctcgggttcataccagcaactgggcatttgactactggggccagggaaccacggtcaccgtctcctca

SEQ ID NO: 20911 - skipped

SEQ ID NO: 20912 - protein, 113 aa, Artificial Sequence
  Description of Artificial Sequence: Synthetic polypeptide
DIVMTQTPDSLAVSLGERATINCKSSQSLLYSSNNKNYLAWYQQKPGQPPKLLIYWASTRESGVPDRFSGSGSGTDFTLTINSLQAEDVAVYYCQQYYSTPHTFGQGTKVDIK

SEQ ID NO: 20913 - protein, 23 aa, Artificial Sequence
  Description of Artificial Sequence: Synthetic peptide
DIVMTQTPDSLAVSLGERATINC

SEQ ID NO: 20914 - protein, 17 aa, Artificial Sequence
  Description of Artificial Sequence: Synthetic peptide
KSSQSLLYSSNNKNYLA

SEQ ID NO: 20915 - protein, 15 aa, Artificial Sequence
  Description of Artificial Sequence: Synthetic peptide
WYQQKPGQPPKLLIY

SEQ ID NO: 20916 - protein, 7 aa, Artificial Sequence
  Description of Artificial Sequence: Synthetic peptide
WASTRES

SEQ ID NO: 20917 - protein, 32 aa, Artificial Sequence
  Description of Artificial Sequence: Synthetic polypeptide
GVPDRFSGSGSGTDFTLTINSLQAEDVAVYYC

SEQ ID NO: 20918 - protein, 9 aa, Artificial Sequence
  Description of Artificial Sequence: Synthetic peptide
QQYYSTPHT

SEQ ID NO: 20919 - protein, 10 aa, Artificial Sequence
  Description of Artificial Sequence: Synthetic peptide
FGQGTKVDIK

SEQ ID NO: 20920 - DNA, 339 bp, Artificial Sequence
  Description of Artificial Sequence: Synthetic polynucleotide
gatattgtgatgacccagactccagactccctggctgtgtctctgggcgagagggccaccatcaactgcaagtccagccagagtcttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcaacagcctgcaggctgaagatgtggcagtttattactgtcagcaatattatagtactcctcacacttttggccaggggaccaaagtggatatcaaa

SEQ ID NO: 20921-21001 - skipped (81 entries)

SEQ ID NO: 21002 - protein, 118 aa, Artificial Sequence
  Description of Artificial Sequence: Synthetic polypeptide
EVQLVESGGGLVKPGESLRLSCAASGLTSRDVWMSWVRQAPGKGLEWVGRLKKQLDGGTIDYAAPVKGRFTISKHDSTNTFYLQMNSLKTEDAAVYYCATGGHYFGSWGQGTLVTVSS

SEQ ID NO: 21003 - protein, 26 aa, Artificial Sequence
  Description of Artificial Sequence: Synthetic peptide
EVQLVESGGGLVKPGESLRLSCAASG

SEQ ID NO: 21004 - protein, 9 aa, Artificial Sequence
  Description of Artificial Sequence: Synthetic peptide
LTSRDVWMS

SEQ ID NO: 21005 - protein, 14 aa, Artificial Sequence
  Description of Artificial Sequence: Synthetic peptide
WVRQAPGKGLEWVG

SEQ ID NO: 21006 - protein, 19 aa, Artificial Sequence
  Description of Artificial Sequence: Synthetic peptide
RLKKQLDGGTIDYAAPVKG

SEQ ID NO: 21007 - protein, 30 aa, Artificial Sequence
  Description of Artificial Sequence: Synthetic polypeptide
RFTISKHDSTNTFYLQMNSLKTEDAAVYYC

SEQ ID NO: 21008 - protein, 9 aa, Artificial Sequence
  Description of Artificial Sequence: Synthetic peptide
ATGGHYFGS

SEQ ID NO: 21009 - protein, 11 aa, Artificial Sequence
  Description of Artificial Sequence: Synthetic peptide
WGQGTLVTVSS

SEQ ID NO: 21010 - DNA, 354 bp, Artificial Sequence
  Description of Artificial Sequence: Synthetic polynucleotide
gaggtgcagctggtggagtctgggggaggcttggtgaagcctggggagtccctaagactctcctgtgcagcctctggattaacttcaagggacgtttggatgagttgggtccgccaggctccagggaaggggctggagtgggttggtcgtcttaaaaagcaacttgacggggggaccattgactacgctgcacccgtgaaaggcagattcaccatctcaaaacatgattcaacaaacacattctatctgcaaatgaacagcctgaaaaccgaggacgcagccgtgtattattgtgcgacagggggtcactactttggttcctggggccagggaaccctggtcaccgtctcctca

SEQ ID NO: 21011 - skipped

SEQ ID NO: 21012 - protein, 108 aa, Artificial Sequence
  Description of Artificial Sequence: Synthetic polypeptide
QPVLTQPASVSGSPGQSITISCSGSSSDFGDYNFVSWYQQHPGRVPKLIIYDVTHRPSGVSNRFSASKSGNTASLTISGLQAEDEADYYCSSYTSGVVFGGGTKLTVL

SEQ ID NO: 21013 - protein, 22 aa, Artificial Sequence
  Description of Artificial Sequence: Synthetic peptide
QPVLTQPASVSGSPGQSITISC

SEQ ID NO: 21014 - protein, 14 aa, Artificial Sequence
  Description of Artificial Sequence: Synthetic peptide
SGSSSDFGDYNFVS

SEQ ID NO: 21015 - protein, 15 aa, Artificial Sequence
  Description of Artificial Sequence: Synthetic peptide
WYQQHPGRVPKLIIY

SEQ ID NO: 21016 - protein, 7 aa, Artificial Sequence
  Description of Artificial Sequence: Synthetic peptide
DVTHRPS

SEQ ID NO: 21017 - protein, 32 aa, Artificial Sequence
  Description of Artificial Sequence: Synthetic polypeptide
GVSNRFSASKSGNTASLTISGLQAEDEADYYC

SEQ ID NO: 21018 - protein, 8 aa, Artificial Sequence
  Description of Artificial Sequence: Synthetic peptide
SSYTSGVV

SEQ ID NO: 21019 - protein, 10 aa, Artificial Sequence
  Description of Artificial Sequence: Synthetic peptide
FGGGTKLTVL

SEQ ID NO: 21020 - DNA, 324 bp, Artificial Sequence
  Description of Artificial Sequence: Synthetic polynucleotide
cagccagtgctgactcagcctgcctccgtgtctgggtctcctggacagtcgatcaccatctcctgcagtggaagcagtagtgactttggtgattacaactttgtctcctggtaccaacagcacccaggcagagtccccaaactcatcatttatgatgtcactcatcggccctcaggggtttctaatcgtttctctgcctccaagtccggcaacacggcctccctgaccatctctgggctccaggctgaggacgaggctgattattactgcagctcatatactagcggcgtggtgttcggcggagggaccaagctcaccgtccta

SEQ ID NO: 21021-21101 - skipped (81 entries)

SEQ ID NO: 21102 - protein, 118 aa, Artificial Sequence
  Description of Artificial Sequence: Synthetic polypeptide
EVQLVESGGGLVQPGGSLRLSCDASGFTFSSYVMHWVRQAPGKGPVWVSRISHDGSIRSYADSVKGRFTISRDNAKNTLYLQMNSLRAEDTATYYCARDLSWLLFDYWGQGTLVTVSS

SEQ ID NO: 21103 - protein, 26 aa, Artificial Sequence
  Description of Artificial Sequence: Synthetic peptide
EVQLVESGGGLVQPGGSLRLSCDASG

SEQ ID NO: 21104 - protein, 9 aa, Artificial Sequence
  Description of Artificial Sequence: Synthetic peptide
FTFSSYVMH

SEQ ID NO: 21105 - protein, 14 aa, Artificial Sequence
  Description of Artificial Sequence: Synthetic peptide
WVRQAPGKGPVWVS

SEQ ID NO: 21106 - protein, 17 aa, Artificial Sequence
  Description of Artificial Sequence: Synthetic peptide
RISHDGSIRSYADSVKG

SEQ ID NO: 21107 - protein, 30 aa, Artificial Sequence
  Description of Artificial Sequence: Synthetic polypeptide
RFTISRDNAKNTLYLQMNSLRAEDTATYYC

SEQ ID NO: 21108 - protein, 11 aa, Artificial Sequence
  Description of Artificial Sequence: Synthetic peptide
ARDLSWLLFDY

SEQ ID NO: 21109 - protein, 11 aa, Artificial Sequence
  Description of Artificial Sequence: Synthetic peptide
WGQGTLVTVSS

SEQ ID NO: 21110 - DNA, 354 bp, Artificial Sequence
  Description of Artificial Sequence: Synthetic polynucleotide
gaggtgcagctggtggagtccgggggaggcttagttcagccgggggggtccctgagactctcctgtgatgcctctggattcaccttcagtagctacgtcatgcactgggtccgccaagctccagggaaggggccggtgtgggtctcgcgtattagtcatgatgggagtatcagaagctacgcggactccgtgaagggccgattcaccatctccagagacaacgccaagaacacgctgtatctgcaaatgaacagtctgagagccgaggacacggctacttattactgtgcaagagatttgtcgtggctgctatttgactactggggccagggaaccctggtcaccgtctcctca

SEQ ID NO: 21111 - skipped

SEQ ID NO: 21112 - protein, 110 aa, Artificial Sequence
  Description of Artificial Sequence: Synthetic polypeptide
SYELTQPPSASGTPGQRVTMSCSGSSSTIGNYDVHWYHQLPGTAPKLLIYGNNERSSGVPDRISGSKSGTSASLAISGLRSEDEGDYYCAVWDDSLTGVVFGGGTKLTVL

SEQ ID NO: 21113 - protein, 22 aa, Artificial Sequence
  Description of Artificial Sequence: Synthetic peptide
SYELTQPPSASGTPGQRVTMSC

SEQ ID NO: 21114 - protein, 13 aa, Artificial Sequence
  Description of Artificial Sequence: Synthetic peptide
SGSSSTIGNYDVH

SEQ ID NO: 21115 - protein, 15 aa, Artificial Sequence
  Description of Artificial Sequence: Synthetic peptide
WYHQLPGTAPKLLIY

SEQ ID NO: 21116 - protein, 7 aa, Artificial Sequence
  Description of Artificial Sequence: Synthetic peptide
GNNERSS

SEQ ID NO: 21117 - protein, 32 aa, Artificial Sequence
  Description of Artificial Sequence: Synthetic polypeptide
GVPDRISGSKSGTSASLAISGLRSEDEGDYYC

SEQ ID NO: 21118 - protein, 11 aa, Artificial Sequence
  Description of Artificial Sequence: Synthetic peptide
AVWDDSLTGVV

SEQ ID NO: 21119 - protein, 10 aa, Artificial Sequence
  Description of Artificial Sequence: Synthetic peptide
FGGGTKLTVL

SEQ ID NO: 21120 - DNA, 330 bp, Artificial Sequence
  Description of Artificial Sequence: Synthetic polynucleotide
tcctatgagctgacacagccaccctcagcgtctgggacccccggacagagggtcaccatgtcttgttctggaagcagctccaccatcggcaattatgatgtacactggtatcaccaactcccaggaacggcccccaaactcctcatctatgggaataatgagcggtcctcaggggtccctgaccgaatctctggctccaagtctggcacttcagcctccctggccatcagtggactccggtccgaggatgagggtgattactactgtgcagtatgggatgacagcctgactggtgtggtattcggcggagggaccaagctcaccgtccta

SEQ ID NO: 21121-21201 - skipped (81 entries)

SEQ ID NO: 21202 - protein, 121 aa, Artificial Sequence
  Description of Artificial Sequence: Synthetic polypeptide
QVQLVESGGGLVQPGGSLRLSCSASGFTFSRFAMHWVRQAPGKGLEYVSAINLNGDSKYYTDSVRGRFTISRDNSKNTLYLQMSSVRPDDTAFYYCVKDGGYYDSSGPGHWGQGTLVTVSS

SEQ ID NO: 21203 - protein, 26 aa, Artificial Sequence
  Description of Artificial Sequence: Synthetic peptide
QVQLVESGGGLVQPGGSLRLSCSASG

SEQ ID NO: 21204 - protein, 9 aa, Artificial Sequence
  Description of Artificial Sequence: Synthetic peptide
FTFSRFAMH

SEQ ID NO: 21205 - protein, 14 aa, Artificial Sequence
  Description of Artificial Sequence: Synthetic peptide
WVRQAPGKGLEYVS

SEQ ID NO: 21206 - protein, 17 aa, Artificial Sequence
  Description of Artificial Sequence: Synthetic peptide
AINLNGDSKYYTDSVRG

SEQ ID NO: 21207 - protein, 30 aa, Artificial Sequence; identical to SEQ ID NO: 207
  Description of Artificial Sequence: Synthetic polypeptide

SEQ ID NO: 21208 - protein, 14 aa, Artificial Sequence
  Description of Artificial Sequence: Synthetic peptide
VKDGGYYDSSGPGH

SEQ ID NO: 21209 - protein, 11 aa, Artificial Sequence
  Description of Artificial Sequence: Synthetic peptide
WGQGTLVTVSS

SEQ ID NO: 21210 - DNA, 363 bp, Artificial Sequence
  Description of Artificial Sequence: Synthetic polynucleotide
caggtgcagctggtggaatctgggggaggcttggtccagcctggggggtccctgagactctcctgttcagcctctggattcaccttcagtagatttgctatgcactgggtccgccaggctccagggaagggactggaatatgtttcagctattaatctcaatggggatagcaagtactacacagactccgtgaggggtagattcaccatctccagagacaactccaagaacacactgtatcttcaaatgagcagtgtgagacctgacgatacggctttttactactgtgtgaaagatgggggttactatgacagtagtggcccggggcactgggggcagggaaccctggtcaccgtctcctca

SEQ ID NO: 21211 - skipped

SEQ ID NO: 21212 - protein, 107 aa, Artificial Sequence
  Description of Artificial Sequence: Synthetic polypeptide
EIVLTQSPATLSLSPGERATLSCRASENILHYLAWYQQKPGQAPRLVIYDASRRATGIPGRFSGSGAGTDFTLTINSLEPEDFAVYYCQQRANWPQNFGGGTKVEIK

SEQ ID NO: 21213 - protein, 23 aa, Artificial Sequence
  Description of Artificial Sequence: Synthetic peptide
EIVLTQSPATLSLSPGERATLSC

SEQ ID NO: 21214 - protein, 11 aa, Artificial Sequence
  Description of Artificial Sequence: Synthetic peptide
RASENILHYLA

SEQ ID NO: 21215 - protein, 15 aa, Artificial Sequence
  Description of Artificial Sequence: Synthetic peptide
WYQQKPGQAPRLVIY

SEQ ID NO: 21216 - protein, 7 aa, Artificial Sequence
  Description of Artificial Sequence: Synthetic peptide
DASRRAT

SEQ ID NO: 21217 - protein, 32 aa, Artificial Sequence; identical to SEQ ID NO: 217
  Description of Artificial Sequence: Synthetic polypeptide

SEQ ID NO: 21218 - protein, 9 aa, Artificial Sequence
  Description of Artificial Sequence: Synthetic peptide
QQRANWPQN

SEQ ID NO: 21219 - protein, 10 aa, Artificial Sequence
  Description of Artificial Sequence: Synthetic peptide
FGGGTKVEIK

SEQ ID NO: 21220 - DNA, 321 bp, Artificial Sequence
  Description of Artificial Sequence: Synthetic polynucleotide
gaaattgtattgacgcagtctcccgccaccctgtctttgtctccaggggaaagagccaccctctcctgcagggccagtgagaatattctgcactacttagcttggtaccaacagaaacctggccaggctcccaggctcgtcatctatgatgcatcccggagggccactggcatcccaggcaggttcagtggcagtggggctgggacagacttcaccctcaccatcaacagcctagagcctgaagattttgcagtttattactgtcagcagcgtgcgaactggcctcagaacttcggcggagggaccaaggtggaaatcaaa

SEQ ID NO: 21221-21301 - skipped (81 entries)

SEQ ID NO: 21302 - protein, 124 aa, Artificial Sequence
  Description of Artificial Sequence: Synthetic polypeptide
EVQLVESGGGLVKPGGSLRLSCAASGFTFSSYYMNWVRQAPGKGLEWVSSISEDGYSTYYPDSLKGRFTISRDSAKNSLYLQMNSLRADDTAVYYCARDFSGHTAWAGTGFEYWGQGTLVTVSS

SEQ ID NO: 21303 - protein, 26 aa, Artificial Sequence
  Description of Artificial Sequence: Synthetic peptide
EVQLVESGGGLVKPGGSLRLSCAASG

SEQ ID NO: 21304 - protein, 9 aa, Artificial Sequence
  Description of Artificial Sequence: Synthetic peptide
FTFSSYYMN

SEQ ID NO: 21305 - protein, 14 aa, Artificial Sequence
  Description of Artificial Sequence: Synthetic peptide
WVRQAPGKGLEWVS

SEQ ID NO: 21306 - protein, 17 aa, Artificial Sequence
  Description of Artificial Sequence: Synthetic peptide
SISEDGYSTYYPDSLKG

SEQ ID NO: 21307 - protein, 30 aa, Artificial Sequence; identical to SEQ ID NO: 107
  Description of Artificial Sequence: Synthetic polypeptide

SEQ ID NO: 21308 - protein, 17 aa, Artificial Sequence
  Description of Artificial Sequence: Synthetic peptide
ARDFSGHTAWAGTGFEY

SEQ ID NO: 21309 - protein, 11 aa, Artificial Sequence
  Description of Artificial Sequence: Synthetic peptide
WGQGTLVTVSS

SEQ ID NO: 21310 - DNA, 372 bp, Artificial Sequence
  Description of Artificial Sequence: Synthetic polynucleotide
gaggtgcagctggtggagtctgggggaggcctggtcaagcctggggggtccctgagactctcctgtgcagcctctggattcacgtttagttcttattacatgaactgggtccgccaggctccagggaagggtctggagtgggtctcatccattagtgaggatggttatagcacatactacccagactcactgaagggccgattcaccatctccagagacagcgccaagaactcactgtatctgcaaatgaacagcctgagagccgacgacacggctgtgtattattgtgcgagagatttttctgggcatacagcatgggctggtaccggtttcgaatactggggccagggaaccctggtcaccgtctcctca

SEQ ID NO: 21311 - skipped

SEQ ID NO: 21312 - protein, 112 aa, Artificial Sequence
  Description of Artificial Sequence: Synthetic polypeptide
QPVLTQPPSVSGAPGQRITISCTGSSSNIGAGYDVHWYQQLPGTAPKLLIYGSSSRNSGVPDRFSGSKSGTSASLAITGLQAEDEADYYCQSYDSSLSVLYTFGTGTKVTVL

SEQ ID NO: 21313 - protein, 22 aa, Artificial Sequence
  Description of Artificial Sequence: Synthetic peptide
QPVLTQPPSVSGAPGQRITISC

SEQ ID NO: 21314 - protein, 14 aa, Artificial Sequence
  Description of Artificial Sequence: Synthetic peptide
TGSSSNIGAGYDVH

SEQ ID NO: 21315 - protein, 15 aa, Artificial Sequence
  Description of Artificial Sequence: Synthetic peptide
WYQQLPGTAPKLLIY

SEQ ID NO: 21316 - protein, 7 aa, Artificial Sequence
  Description of Artificial Sequence: Synthetic peptide
GSSSRNS

SEQ ID NO: 21317 - protein, 32 aa, Artificial Sequence; identical to SEQ ID NO: 117
  Description of Artificial Sequence: Synthetic polypeptide

SEQ ID NO: 21318 - protein, 12 aa, Artificial Sequence
  Description of Artificial Sequence: Synthetic peptide
QSYDSSLSVLYT

SEQ ID NO: 21319 - protein, 10 aa, Artificial Sequence
  Description of Artificial Sequence: Synthetic peptide
FGTGTKVTVL

SEQ ID NO: 21320 - DNA, 336 bp, Artificial Sequence
  Description of Artificial Sequence: Synthetic polynucleotide
cagcctgtgctgactcagccgccctcagtgtctggggccccagggcagaggatcaccatctcctgcactgggagcagctccaacatcggggcaggttatgatgtacactggtaccagcagcttccaggaacagcccccaaactcctcatctatggtagcagcagtcggaattcaggggtccctgaccgattctctggctccaagtctggcacctcagcctccctggccatcactgggctccaggctgaggatgaggctgattattactgccagtcctatgacagcagcctgagtgtcctttatactttcggaactgggaccaaggtcaccgtccta

SEQ ID NO: 21321-21401 - skipped (81 entries)

SEQ ID NO: 21402 - protein, 124 aa, Artificial Sequence
  Description of Artificial Sequence: Synthetic polypeptide
EVQLVESGGGLIQPGGSLRLSCAASGFPFKGTYMTWVRQAPGKGLEWVSIIYSGGDTYYADSVKGRFTISRDNSKNTLFLQMNSLRVEDTAMYYCARDREMAIITERTYGLDVWGQGTMVTVSS

SEQ ID NO: 21403 - protein, 26 aa, Artificial Sequence
  Description of Artificial Sequence: Synthetic peptide
EVQLVESGGGLIQPGGSLRLSCAASG

SEQ ID NO: 21404 - protein, 9 aa, Artificial Sequence
  Description of Artificial Sequence: Synthetic peptide
FPFKGTYMT

SEQ ID NO: 21405 - protein, 14 aa, Artificial Sequence
  Description of Artificial Sequence: Synthetic peptide
WVRQAPGKGLEWVS

SEQ ID NO: 21406 - protein, 16 aa, Artificial Sequence
  Description of Artificial Sequence: Synthetic peptide
IIYSGGDTYYADSVKG

SEQ ID NO: 21407 - protein, 30 aa, Artificial Sequence; identical to SEQ ID NO: 17507
  Description of Artificial Sequence: Synthetic polypeptide

SEQ ID NO: 21408 - protein, 18 aa, Artificial Sequence
  Description of Artificial Sequence: Synthetic peptide
ARDREMAIITERTYGLDV

SEQ ID NO: 21409 - protein, 11 aa, Artificial Sequence
  Description of Artificial Sequence: Synthetic peptide
WGQGTMVTVSS

SEQ ID NO: 21410 - DNA, 372 bp, Artificial Sequence
  Description of Artificial Sequence: Synthetic polynucleotide
gaggtgcagctggtggagtctggaggaggcttgatccagcctggggggtccctgagactctcctgtgcagcctctgggttccccttcaagggcacttacatgacctgggtccgccaggctccagggaaggggctggagtgggtctcaattatttatagcggtggtgacacatactacgcagactccgtgaagggccgattcaccatctccagagacaattccaagaacacgctgtttcttcaaatgaacagcctgagagtcgaggacacggccatgtattactgtgcgagagatcgggagatggctataattacagagcgtacgtacggtttggacgtctggggccaagggaccatggtcaccgtctcttca

SEQ ID NO: 21411 - skipped

SEQ ID NO: 21412 - protein, 112 aa, Artificial Sequence; identical to SEQ ID NO: 17512
  Description of Artificial Sequence: Synthetic polypeptide

SEQ ID NO: 21413 - protein, 22 aa, Artificial Sequence
  Description of Artificial Sequence: Synthetic peptide
QPVLTQPPSASGTPGQRVTISC

SEQ ID NO: 21414 - protein, 13 aa, Artificial Sequence
  Description of Artificial Sequence: Synthetic peptide
SGGSSNIGSNSVN

SEQ ID NO: 21415 - protein, 15 aa, Artificial Sequence
  Description of Artificial Sequence: Synthetic peptide
WYQQLPGTAPKLLIY

SEQ ID NO: 21416 - protein, 7 aa, Artificial Sequence
  Description of Artificial Sequence: Synthetic peptide
SNSQRPS

SEQ ID NO: 21417 - protein, 32 aa, Artificial Sequence; identical to SEQ ID NO: 17517
  Description of Artificial Sequence: Synthetic polypeptide

SEQ ID NO: 21418 - protein, 13 aa, Artificial Sequence
  Description of Artificial Sequence: Synthetic peptide
AAWDDSLNTFRYV

SEQ ID NO: 21419 - protein, 10 aa, Artificial Sequence
  Description of Artificial Sequence: Synthetic peptide
FGTGTKVTVL

SEQ ID NO: 21420 - DNA, 336 bp, Artificial Sequence; identical to SEQ ID NO: 17520
  Description of Artificial Sequence: Synthetic polynucleotide

SEQ ID NO: 21421-21501 - skipped (81 entries)

SEQ ID NO: 21502 - protein, 129 aa, Artificial Sequence
  Description of Artificial Sequence: Synthetic polypeptide
EVQLLESGAEVKKPGSSVKVSCKASGGTFSSYAISWVRQAPGQGLEWMGGIIPIFVTANYAQKFQGRVTITADKSTTTVYMELSSLRSEDTAVYYCARGRMATIRGGQNYYYYYGMDVWGQGTTVTVSS

SEQ ID NO: 21503 - protein, 26 aa, Artificial Sequence
  Description of Artificial Sequence: Synthetic peptide
EVQLLESGAEVKKPGSSVKVSCKASG

SEQ ID NO: 21504 - protein, 9 aa, Artificial Sequence
  Description of Artificial Sequence: Synthetic peptide
GTFSSYAIS

SEQ ID NO: 21505 - protein, 14 aa, Artificial Sequence
  Description of Artificial Sequence: Synthetic peptide
WVRQAPGQGLEWMG

SEQ ID NO: 21506 - protein, 17 aa, Artificial Sequence
  Description of Artificial Sequence: Synthetic peptide
GIIPIFVTANYAQKFQG

SEQ ID NO: 21507 - protein, 30 aa, Artificial Sequence
  Description of Artificial Sequence: Synthetic polypeptide
RVTITADKSTTTVYMELSSLRSEDTAVYYC

SEQ ID NO: 21508 - protein, 22 aa, Artificial Sequence
  Description of Artificial Sequence: Synthetic peptide
ARGRMATIRGGQNYYYYYGMDV

SEQ ID NO: 21509 - protein, 11 aa, Artificial Sequence
  Description of Artificial Sequence: Synthetic peptide
WGQGTTVTVSS

SEQ ID NO: 21510 - DNA, 387 bp, Artificial Sequence
  Description of Artificial Sequence: Synthetic polynucleotide
gaggtgcagctgttggagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttgttacagcaaactacgcacagaagttccagggcagagtcacgattaccgcggacaaatccacgaccacagtttacatggagctgagcagcctgagatctgaggacacggccgtgtattactgtgcgagggggaggatggctacaattcgcgggggtcaaaattactactactactacggtatggacgtctggggccaagggaccacggtcaccgtctcctca

SEQ ID NO: 21511 - skipped

SEQ ID NO: 21512 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGPGTKVDIK

SEQ ID NO: 21513 - protein, 23 aa, Artificial Sequence
  Description of Artificial Sequence: Synthetic peptide
DIQMTQSPSSLSASVGDRVTITC

SEQ ID NO: 21514 - protein, 11 aa, Artificial Sequence
  Description of Artificial Sequence: Synthetic peptide
QASQDISNYLN

SEQ ID NO: 21515 - protein, 15 aa, Artificial Sequence
  Description of Artificial Sequence: Synthetic peptide
WYQQKPGKAPKLLIY

SEQ ID NO: 21516 - protein, 7 aa, Artificial Sequence
  Description of Artificial Sequence: Synthetic peptide
DASNLET

SEQ ID NO: 21517 - protein, 32 aa, Artificial Sequence
  Description of Artificial Sequence: Synthetic polypeptide
GVPSRFSGSGSGTDFTFTISSLQPEDIATYYC

SEQ ID NO: 21518 - protein, 9 aa, Artificial Sequence
  Description of Artificial Sequence: Synthetic peptide
QQYDNLPLT

SEQ ID NO: 21519 - protein, 10 aa, Artificial Sequence
  Description of Artificial Sequence: Synthetic peptide
FGPGTKVDIK

SEQ ID NO: 21520 - DNA, 321 bp, Artificial Sequence
  Description of Artificial Sequence: Synthetic polynucleotide
gacatccagatgacccagtctccatcctccctgtctgcatctgtaggagacagagtcaccatcacttgccaggcgagtcaggacattagcaactatttaaattggtatcagcagaaaccagggaaagcccctaaactcctgatctacgatgcatccaatttggaaacaggggtcccatcaaggttcagtggaagtggatctgggacagattttactttcaccatcagcagcctgcagcctgaagatattgcaacatattactgtcaacagtatgataatctccccctcactttcggccctgggaccaaagtggatatcaaa

SEQ ID NO: 21521-21601 - skipped (81 entries)

SEQ ID NO: 21602 - protein, 124 aa, Artificial Sequence
  Description of Artificial Sequence: Synthetic polypeptide
EVQLLESGGGLVQPGRSLRLSCAASGFTFDDYAMHWVRQAPGKGLEWVSGISWNSGSINYADSVKGRFTISRDNAKNSLYLQMNSLRAEDTALYYCASDSNYRDYYYHYGMDVWGQGTTVTVSS

SEQ ID NO: 21603 - protein, 26 aa, Artificial Sequence
  Description of Artificial Sequence: Synthetic peptide
EVQLLESGGGLVQPGRSLRLSCAASG

SEQ ID NO: 21604 - protein, 9 aa, Artificial Sequence
  Description of Artificial Sequence: Synthetic peptide
FTFDDYAMH

SEQ ID NO: 21605 - protein, 14 aa, Artificial Sequence
  Description of Artificial Sequence: Synthetic peptide
WVRQAPGKGLEWVS

SEQ ID NO: 21606 - protein, 17 aa, Artificial Sequence
  Description of Artificial Sequence: Synthetic peptide
GISWNSGSINYADSVKG

SEQ ID NO: 21607 - protein, 30 aa, Artificial Sequence; identical to SEQ ID NO: 13807
  Description of Artificial Sequence: Synthetic polypeptide

SEQ ID NO: 21608 - protein, 17 aa, Artificial Sequence
  Description of Artificial Sequence: Synthetic peptide
ASDSNYRDYYYHYGMDV

SEQ ID NO: 21609 - protein, 11 aa, Artificial Sequence
  Description of Artificial Sequence: Synthetic peptide
WGQGTTVTVSS

SEQ ID NO: 21610 - DNA, 372 bp, Artificial Sequence
  Description of Artificial Sequence: Synthetic polynucleotide
gaggtgcagctgttggagtctgggggaggcttggtacagcctggcaggtccctgagactctcctgtgcagcctctggattcacctttgatgattatgccatgcactgggtccggcaagctccaggaaagggcctggagtgggtctcaggtattagttggaatagtggtagcataaactatgcggactctgtgaagggccgattcaccatctccagagacaacgccaagaactccctgtatctgcaaatgaacagtctgagagctgaggacacggccttgtattactgtgcctcggacagcaactaccgagattactactaccactacggtatggacgtctggggccaagggaccacggtcaccgtctcctca

SEQ ID NO: 21611 - skipped

SEQ ID NO: 21612 - protein, 112 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPRTFGQGTKVEIK

SEQ ID NO: 21613 - protein, 23 aa, Artificial Sequence
  Description of Artificial Sequence: Synthetic peptide
DIVMTQSPLSLPVTPGEPASISC

SEQ ID NO: 21614 - protein, 16 aa, Artificial Sequence
  Description of Artificial Sequence: Synthetic peptide
RSSQSLLHSNGYNYLD

SEQ ID NO: 21615 - protein, 15 aa, Artificial Sequence
  Description of Artificial Sequence: Synthetic peptide
WYLQKPGQSPQLLIY

SEQ ID NO: 21616 - protein, 7 aa, Artificial Sequence
  Description of Artificial Sequence: Synthetic peptide
LGSNRAS

SEQ ID NO: 21617 - protein, 32 aa, Artificial Sequence; identical to SEQ ID NO: 917
  Description of Artificial Sequence: Synthetic polypeptide

SEQ ID NO: 21618 - protein, 9 aa, Artificial Sequence
  Description of Artificial Sequence: Synthetic peptide
MQALQTPRT

SEQ ID NO: 21619 - protein, 10 aa, Artificial Sequence
  Description of Artificial Sequence: Synthetic peptide
FGQGTKVEIK

SEQ ID NO: 21620 - DNA, 336 bp, Artificial Sequence
  Description of Artificial Sequence: Synthetic polynucleotide
gatattgtgatgacgcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcggacgttcggccaagggaccaaggtggaaatcaaa

SEQ ID NO: 21621-21700 - skipped (80 entries)

SEQ ID NO: 21701 - protein, 451 aa, Artificial Sequence
  Description of Artificial Sequence: Synthetic polypeptide
EVQLVESGGGLVQPGGSLRLSCSASGFTFSRFAMHWVRQAPGKGLEYVSAINLNGDSKYYTDSVRGRFTISRDNSKNTLYLQMSSVRPDDTAFYYCVKDGGYYDSSGPGHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21702 - protein, 121 aa, Artificial Sequence
  Description of Artificial Sequence: Synthetic polypeptide
EVQLVESGGGLVQPGGSLRLSCSASGFTFSRFAMHWVRQAPGKGLEYVSAINLNGDSKYYTDSVRGRFTISRDNSKNTLYLQMSSVRPDDTAFYYCVKDGGYYDSSGPGHWGQGTLVTVSS

SEQ ID NO: 21703 - protein, 26 aa, Artificial Sequence
  Description of Artificial Sequence: Synthetic peptide
EVQLVESGGGLVQPGGSLRLSCSASG

SEQ ID NO: 21704 - protein, 9 aa, Artificial Sequence
  Description of Artificial Sequence: Synthetic peptide
FTFSRFAMH

SEQ ID NO: 21705 - protein, 14 aa, Artificial Sequence
  Description of Artificial Sequence: Synthetic peptide
WVRQAPGKGLEYVS

SEQ ID NO: 21706 - protein, 17 aa, Artificial Sequence
  Description of Artificial Sequence: Synthetic peptide
AINLNGDSKYYTDSVRG

SEQ ID NO: 21707 - protein, 30 aa, Artificial Sequence; identical to SEQ ID NO: 207
  Description of Artificial Sequence: Synthetic polypeptide

SEQ ID NO: 21708 - protein, 14 aa, Artificial Sequence
  Description of Artificial Sequence: Synthetic peptide
VKDGGYYDSSGPGH

SEQ ID NO: 21709 - protein, 11 aa, Artificial Sequence
  Description of Artificial Sequence: Synthetic peptide
WGQGTLVTVSS

SEQ ID NO: 21710 - DNA, 363 bp, Artificial Sequence
  Description of Artificial Sequence: Synthetic polynucleotide
gaggtgcagctggtggagtctgggggaggcttggtccagcctggggggtccctgagactttcctgttcagcctctggattcaccttcagtaggtttgctatgcactgggtcaggcaggctccagggaagggactggaatatgtttcagctattaatctgaatggggacagcaaatactacaccgactccgtgaggggcagattcaccatctccagagacaattccaagaacacgctgtatcttcaaatgagcagtgtgagacccgacgacacggctttctattactgtgtaaaagacgggggttactacgattcctccggtcctgggcactgggggcaagggaccttggtcaccgtctcctca

SEQ ID NO: 21711 - protein, 214 aa, Artificial Sequence
  Description of Artificial Sequence: Synthetic polypeptide
EIVLTQSPATLSLSPGERATLSCRASENILHYLAWYQQKPGQAPRLVIYDASRRATGIPGRFSGSGAGTDFTLTINSLEPEDFAVYYCQQRANWPQNFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21712 - protein, 107 aa, Artificial Sequence; identical to SEQ ID NO: 21212
  Description of Artificial Sequence: Synthetic polypeptide

SEQ ID NO: 21713 - protein, 23 aa, Artificial Sequence
  Description of Artificial Sequence: Synthetic peptide
EIVLTQSPATLSLSPGERATLSC

SEQ ID NO: 21714 - protein, 11 aa, Artificial Sequence
  Description of Artificial Sequence: Synthetic peptide
RASENILHYLA

SEQ ID NO: 21715 - protein, 15 aa, Artificial Sequence
  Description of Artificial Sequence: Synthetic peptide
WYQQKPGQAPRLVIY

SEQ ID NO: 21716 - protein, 7 aa, Artificial Sequence
  Description of Artificial Sequence: Synthetic peptide
DASRRAT

SEQ ID NO: 21717 - protein, 32 aa, Artificial Sequence; identical to SEQ ID NO: 217
  Description of Artificial Sequence: Synthetic polypeptide

SEQ ID NO: 21718 - protein, 9 aa, Artificial Sequence
  Description of Artificial Sequence: Synthetic peptide
QQRANWPQN

SEQ ID NO: 21719 - protein, 10 aa, Artificial Sequence
  Description of Artificial Sequence: Synthetic peptide
FGGGTKVEIK

SEQ ID NO: 21720 - DNA, 321 bp, Artificial Sequence
  Description of Artificial Sequence: Synthetic polynucleotide
gaaattgtgttgacacagtctccagccaccctgtctttgtctccaggggaaagagccaccctgtcctgcagggccagtgaaaatatattgcactacttggcctggtaccaacagaaacctggccaggctcccaggcttgtcatctatgatgcatccaggagggccactggcatcccaggaaggttcagtggcagtggggcggggacagacttcactctgaccatcaatagcttggagcctgaagattttgcagtttattactgtcaacaaagagccaattggccccaaaacttcggcggagggaccaaggtggagatcaaa

SEQ ID NO: 21721-21800 - skipped (80 entries)

SEQ ID NO: 21801 - protein, 451 aa, Artificial Sequence
  Description of Artificial Sequence: Synthetic polypeptide
EVQLVESGGGLVQPGGSLRLSCSASGFTFSRFAMHWVRQAPGKGLEYVSAINLNGDSKYYTDSVRGRFTISRDNSKNTLYLQMSSVRPDDTAFYYCVKDGGYYDSSGPGHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21802 - protein, 121 aa, Artificial Sequence; identical to SEQ ID NO: 21702
  Description of Artificial Sequence: Synthetic polypeptide

SEQ ID NO: 21803 - protein, 26 aa, Artificial Sequence
  Description of Artificial Sequence: Synthetic peptide
EVQLVESGGGLVQPGGSLRLSCSASG

SEQ ID NO: 21804 - protein, 9 aa, Artificial Sequence
  Description of Artificial Sequence: Synthetic peptide
FTFSRFAMH

SEQ ID NO: 21805 - protein, 14 aa, Artificial Sequence
  Description of Artificial Sequence: Synthetic peptide
WVRQAPGKGLEYVS

SEQ ID NO: 21806 - protein, 17 aa, Artificial Sequence
  Description of Artificial Sequence: Synthetic peptide
AINLNGDSKYYTDSVRG

SEQ ID NO: 21807 - protein, 30 aa, Artificial Sequence; identical to SEQ ID NO: 207
  Description of Artificial Sequence: Synthetic polypeptide

SEQ ID NO: 21808 - protein, 14 aa, Artificial Sequence
  Description of Artificial Sequence: Synthetic peptide
VKDGGYYDSSGPGH

SEQ ID NO: 21809 - protein, 11 aa, Artificial Sequence
  Description of Artificial Sequence: Synthetic peptide
WGQGTLVTVSS

SEQ ID NO: 21810 - DNA, 363 bp, Artificial Sequence
  Description of Artificial Sequence: Synthetic polynucleotide
gaggtgcagctggtggagtctgggggaggcttggtccagcctggggggtccctgagattgtcctgttcagcctctggattcaccttcagtaggtttgctatgcactgggtcaggcaggctccagggaagggactggaatatgtttcagctattaatctgaatggggatagcaagtactacacagactccgtgagaggcagattcaccatctccagagacaattccaagaacacgctgtatcttcaaatgagcagtgtaagaccagacgacacggctttctattactgtgttaaggatggcggctactacgatagttccggtcctggtcactgggggcaagggacccttgtcaccgtctcctca

SEQ ID NO: 21811 - protein, 214 aa, Artificial Sequence; identical to SEQ ID NO: 21711
  Description of Artificial Sequence: Synthetic polypeptide

SEQ ID NO: 21812 - protein, 107 aa, Artificial Sequence; identical to SEQ ID NO: 21212
  Description of Artificial Sequence: Synthetic polypeptide

SEQ ID NO: 21813 - protein, 23 aa, Artificial Sequence
  Description of Artificial Sequence: Synthetic peptide
EIVLTQSPATLSLSPGERATLSC

SEQ ID NO: 21814 - protein, 11 aa, Artificial Sequence
  Description of Artificial Sequence: Synthetic peptide
RASENILHYLA

SEQ ID NO: 21815 - protein, 15 aa, Artificial Sequence
  Description of Artificial Sequence: Synthetic peptide
WYQQKPGQAPRLVIY

SEQ ID NO: 21816 - protein, 7 aa, Artificial Sequence
  Description of Artificial Sequence: Synthetic peptide
DASRRAT

SEQ ID NO: 21817 - protein, 32 aa, Artificial Sequence; identical to SEQ ID NO: 217
  Description of Artificial Sequence: Synthetic polypeptide

SEQ ID NO: 21818 - protein, 9 aa, Artificial Sequence
  Description of Artificial Sequence: Synthetic peptide
QQRANWPQN

SEQ ID NO: 21819 - protein, 10 aa, Artificial Sequence
  Description of Artificial Sequence: Synthetic peptide
FGGGTKVEIK

SEQ ID NO: 21820 - DNA, 321 bp, Artificial Sequence
  Description of Artificial Sequence: Synthetic polynucleotide
gaaattgtgttgacacagtctccagccaccctgtctttgtctccaggggaaagagccaccctttcctgcagggccagtgagaacatcctgcactacttggcctggtaccaacagaaacctggccaggctcccaggttggtaatctatgatgcatccaggagggccactggcatcccaggtaggttcagtggcagtggggcggggacagacttcactctgaccatcaacagcctggagcctgaagattttgcagtttattactgtcaacaaagagccaattggccacagaatttcggcggagggaccaaggtggagatcaaa

SEQ ID NO: 21821-21900 - skipped (80 entries)

SEQ ID NO: 21901 - protein, 451 aa, Artificial Sequence
  Description of Artificial Sequence: Synthetic polypeptide
EVQLVESGGGLVQPGGSLRLSCSASGFTFSRFAMHWVRQAPGKGLEYVSAINLNGDSKYYTDSVRGRFTISRDNSKNTLYLQMSSVRPDDTAFYYCVKDGGYYDSSGPGHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHYTQKSLSLSPGK

SEQ ID NO: 21902 - protein, 121 aa, Artificial Sequence; identical to SEQ ID NO: 21702
  Description of Artificial Sequence: Synthetic polypeptide

SEQ ID NO: 21903 - protein, 26 aa, Artificial Sequence
  Description of Artificial Sequence: Synthetic peptide
EVQLVESGGGLVQPGGSLRLSCSASG

SEQ ID NO: 21904 - protein, 9 aa, Artificial Sequence
  Description of Artificial Sequence: Synthetic peptide
FTFSRFAMH

SEQ ID NO: 21905 - protein, 14 aa, Artificial Sequence
  Description of Artificial Sequence: Synthetic peptide
WVRQAPGKGLEYVS

SEQ ID NO: 21906 - protein, 17 aa, Artificial Sequence
  Description of Artificial Sequence: Synthetic peptide
AINLNGDSKYYTDSVRG

SEQ ID NO: 21907 - protein, 30 aa, Artificial Sequence; identical to SEQ ID NO: 207
  Description of Artificial Sequence: Synthetic polypeptide

SEQ ID NO: 21908 - protein, 14 aa, Artificial Sequence
  Description of Artificial Sequence: Synthetic peptide
VKDGGYYDSSGPGH

SEQ ID NO: 21909 - protein, 11 aa, Artificial Sequence
  Description of Artificial Sequence: Synthetic peptide
WGQGTLVTVSS

SEQ ID NO: 21910 - DNA, 363 bp, Artificial Sequence
  Description of Artificial Sequence: Synthetic polynucleotide
gaggtgcagctggtggagtctgggggaggcttggtccagcctggggggtccctgagactttcctgttcagcctctggattcaccttcagtagattcgctatgcactgggtcaggcaggctccagggaagggactggaatatgtttcagctattaatcttaatggggacagcaagtactacaccgactccgtgaggggcagattcaccatctccagagacaattccaagaacacgctgtatcttcaaatgagcagtgttagacctgacgacacggctttctattactgtgtaaaagacggaggatactacgacagttccggtcccggacactgggggcaagggacccttgtcaccgtctcctca

SEQ ID NO: 21911 - protein, 214 aa, Artificial Sequence; identical to SEQ ID NO: 21711
  Description of Artificial Sequence: Synthetic polypeptide

SEQ ID NO: 21912 - protein, 107 aa, Artificial Sequence; identical to SEQ ID NO: 21212
  Description of Artificial Sequence: Synthetic polypeptide

SEQ ID NO: 21913 - protein, 23 aa, Artificial Sequence
  Description of Artificial Sequence: Synthetic peptide
EIVLTQSPATLSLSPGERATLSC

SEQ ID NO: 21914 - protein, 11 aa, Artificial Sequence
  Description of Artificial Sequence: Synthetic peptide
RASENILHYLA

SEQ ID NO: 21915 - protein, 15 aa, Artificial Sequence
  Description of Artificial Sequence: Synthetic peptide
WYQQKPGQAPRLVIY

SEQ ID NO: 21916 - protein, 7 aa, Artificial Sequence
  Description of Artificial Sequence: Synthetic peptide
DASRRAT

SEQ ID NO: 21917 - protein, 32 aa, Artificial Sequence; identical to SEQ ID NO: 217
  Description of Artificial Sequence: Synthetic polypeptide

SEQ ID NO: 21918 - protein, 9 aa, Artificial Sequence
  Description of Artificial Sequence: Synthetic peptide
QQRANWPQN

SEQ ID NO: 21919 - protein, 10 aa, Artificial Sequence
  Description of Artificial Sequence: Synthetic peptide
FGGGTKVEIK

SEQ ID NO: 21920 - DNA, 321 bp, Artificial Sequence
  Description of Artificial Sequence: Synthetic polynucleotide
gaaattgtgttgacacagtctccagccaccctgtctttgtctccaggggaaagagccaccctttcctgcagggccagtgagaatattttgcactacttggcctggtaccaacagaaacctggccaggctcccaggctggttatctatgatgcatccagaagggccactggcatcccagggaggttcagtggcagtggggccgggacagacttcactctgaccatcaatagcctggagcctgaagattttgcagtttattactgtcaacagagggcgaactggcctcaaaacttcggcggagggaccaaggtggagatcaaa

SEQ ID NO: 21921-22000 - skipped (80 entries)

SEQ ID NO: 22001 - protein, 451 aa, Artificial Sequence
  Description of Artificial Sequence: Synthetic polypeptide
EVQLVESGGGLVQPGGSLRLSCSASGFTFSRFAMHWVRQAPGKGLEYVSAINLNGDSKYYTDSVRGRFTISRDNSKNTLYLQMSSVRPDDTAFYYCVKDGGYYDSSGPGHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 22002 - protein, 121 aa, Artificial Sequence; identical to SEQ ID NO: 21702
  Description of Artificial Sequence: Synthetic polypeptide

SEQ ID NO: 22003 - protein, 26 aa, Artificial Sequence
  Description of Artificial Sequence: Synthetic peptide
EVQLVESGGGLVQPGGSLRLSCSASG

SEQ ID NO: 22004 - protein, 9 aa, Artificial Sequence
  Description of Artificial Sequence: Synthetic peptide
FTFSRFAMH

SEQ ID NO: 22005 - protein, 14 aa, Artificial Sequence
  Description of Artificial Sequence: Synthetic peptide
WVRQAPGKGLEYVS

SEQ ID NO: 22006 - protein, 17 aa, Artificial Sequence
  Description of Artificial Sequence: Synthetic peptide
AINLNGDSKYYTDSVRG

SEQ ID NO: 22007 - protein, 30 aa, Artificial Sequence; identical to SEQ ID NO: 207
  Description of Artificial Sequence: Synthetic polypeptide

SEQ ID NO: 22008 - protein, 14 aa, Artificial Sequence
  Description of Artificial Sequence: Synthetic peptide
VKDGGYYDSSGPGH

SEQ ID NO: 22009 - protein, 11 aa, Artificial Sequence
  Description of Artificial Sequence: Synthetic peptide
WGQGTLVTVSS

SEQ ID NO: 22010 - DNA, 363 bp, Artificial Sequence
  Description of Artificial Sequence: Synthetic polynucleotide
gaggtgcagctggtggagtctgggggaggcttggtccagcctggggggtccctgagattgtcctgttcagcctctggattcaccttcagtagatttgctatgcactgggtcaggcaggctccagggaagggactggaatatgtttcagctattaacttgaatggggatagcaaatactacacggactccgtgagaggcagattcaccatctccagagacaattccaagaacacgctgtatcttcaaatgagcagtgttagaccggacgacacggctttctattactgtgtcaaagacgggggatactacgatagtagtggtcctggccactgggggcaagggacccttgtcaccgtctcctca

SEQ ID NO: 22011 - protein, 214 aa, Artificial Sequence; identical to SEQ ID NO: 21711
  Description of Artificial Sequence: Synthetic polypeptide

SEQ ID NO: 22012 - protein, 107 aa, Artificial Sequence; identical to SEQ ID NO: 21212
  Description of Artificial Sequence: Synthetic polypeptide

SEQ ID NO: 22013 - protein, 23 aa, Artificial Sequence
  Description of Artificial Sequence: Synthetic peptide
EIVLTQSPATLSLSPGERATLSC

SEQ ID NO: 22014 - protein, 11 aa, Artificial Sequence
  Description of Artificial Sequence: Synthetic peptide
RASENILHYLA

SEQ ID NO: 22015 - protein, 15 aa, Artificial Sequence
  Description of Artificial Sequence: Synthetic peptide
WYQQKPGQAPRLVIY

SEQ ID NO: 22016 - protein, 7 aa, Artificial Sequence
  Description of Artificial Sequence: Synthetic peptide
DASRRAT

SEQ ID NO: 22017 - protein, 32 aa, Artificial Sequence; identical to SEQ ID NO: 217
  Description of Artificial Sequence: Synthetic polypeptide

SEQ ID NO: 22018 - protein, 9 aa, Artificial Sequence
  Description of Artificial Sequence: Synthetic peptide
QQRANWPQN

SEQ ID NO: 22019 - protein, 10 aa, Artificial Sequence
  Description of Artificial Sequence: Synthetic peptide
FGGGTKVEIK

SEQ ID NO: 22020 - DNA, 321 bp, Artificial Sequence
  Description of Artificial Sequence: Synthetic polynucleotide
gaaattgtgttgacacagtctccagccaccctgtctttgtctccaggggaaagagccaccctttcctgcagggccagtgaaaatatcttgcattacttggcctggtaccaacagaaacctggccaggctcccaggctggtgatctatgatgcatccaggagggccactggcatcccaggcaggttcagtggcagtggggcagggacagacttcactttgaccatcaacagccttgagcctgaagattttgcagtttattactgtcaacagagagcaaattggcctcaaaatttcggcggagggaccaaggtggagatcaaa

SEQ ID NO: 22021-22100 - skipped (80 entries)

SEQ ID NO: 22101 - protein, 451 aa, Artificial Sequence
  Description of Artificial Sequence: Synthetic polypeptide
EVQLVESGGGLVQPGGSLRLSCSASGFTFSRFAMHWVRQAPGKGLEYVSAINLNGDSKYYTDSVRGRFTISRDNSKNTLYLQMSSVRPDDTAFYYCVKDGGYYDSSGPGHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHYTRKELSLSPGK

SEQ ID NO: 22102 - protein, 121 aa, Artificial Sequence; identical to SEQ ID NO: 21702
  Description of Artificial Sequence: Synthetic polypeptide

SEQ ID NO: 22103 - protein, 26 aa, Artificial Sequence
  Description of Artificial Sequence: Synthetic peptide
EVQLVESGGGLVQPGGSLRLSCSASG

SEQ ID NO: 22104 - protein, 9 aa, Artificial Sequence
  Description of Artificial Sequence: Synthetic peptide
FTFSRFAMH

SEQ ID NO: 22105 - protein, 14 aa, Artificial Sequence
  Description of Artificial Sequence: Synthetic peptide
WVRQAPGKGLEYVS

SEQ ID NO: 22106 - protein, 17 aa, Artificial Sequence
  Description of Artificial Sequence: Synthetic peptide
AINLNGDSKYYTDSVRG

SEQ ID NO: 22107 - protein, 30 aa, Artificial Sequence; identical to SEQ ID NO: 207
  Description of Artificial Sequence: Synthetic polypeptide

SEQ ID NO: 22108 - protein, 14 aa, Artificial Sequence
  Description of Artificial Sequence: Synthetic peptide
VKDGGYYDSSGPGH

SEQ ID NO: 22109 - protein, 11 aa, Artificial Sequence
  Description of Artificial Sequence: Synthetic peptide
WGQGTLVTVSS

SEQ ID NO: 22110 - DNA, 363 bp, Artificial Sequence
  Description of Artificial Sequence: Synthetic polynucleotide
gaagtgcagctggtggaaagcggcggcggcctggtgcagccgggcggcagcctgcgcctgagctgcagcgcgagcggctttacctttagccgctttgcgatgcattgggtgcgccaggcgccgggcaaaggcctggaatatgtgagcgcgattaacctgaacggcgatagcaaatattataccgatagcgtgcgcggccgctttaccattagccgcgataacagcaaaaacaccctgtatctgcagatgagcagcgtgcgcccggatgataccgcgttttattattgcgtgaaagatggcggctattatgatagcagcggcccgggccattggggccagggcaccctggtgaccgtgagcagc

SEQ ID NO: 22111 - protein, 214 aa, Artificial Sequence; identical to SEQ ID NO: 21711
  Description of Artificial Sequence: Synthetic polypeptide

SEQ ID NO: 22112 - protein, 107 aa, Artificial Sequence; identical to SEQ ID NO: 21212
  Description of Artificial Sequence: Synthetic polypeptide

SEQ ID NO: 22113 - protein, 23 aa, Artificial Sequence
  Description of Artificial Sequence: Synthetic peptide
EIVLTQSPATLSLSPGERATLSC

SEQ ID NO: 22114 - protein, 11 aa, Artificial Sequence
  Description of Artificial Sequence: Synthetic peptide
RASENILHYLA

SEQ ID NO: 22115 - protein, 15 aa, Artificial Sequence
  Description of Artificial Sequence: Synthetic peptide
WYQQKPGQAPRLVIY

SEQ ID NO: 22116 - protein, 7 aa, Artificial Sequence
  Description of Artificial Sequence: Synthetic peptide
DASRRAT

SEQ ID NO: 22117 - protein, 32 aa, Artificial Sequence; identical to SEQ ID NO: 217
  Description of Artificial Sequence: Synthetic polypeptide

SEQ ID NO: 22118 - protein, 9 aa, Artificial Sequence
  Description of Artificial Sequence: Synthetic peptide
QQRANWPQN

SEQ ID NO: 22119 - protein, 10 aa, Artificial Sequence
  Description of Artificial Sequence: Synthetic peptide
FGGGTKVEIK

SEQ ID NO: 22120 - DNA, 321 bp, Artificial Sequence
  Description of Artificial Sequence: Synthetic polynucleotide
gaaattgtgctgacccagagcccggcgaccctgagcctgagcccgggcgaacgcgcgaccctgagctgccgcgcgagcgaaaacattctgcattatctggcgtggtatcagcagaaaccgggccaggcgccgcgcctggtgatttatgatgcgagccgccgcgcgaccggcattccgggccgctttagcggcagcggcgcgggcaccgattttaccctgaccattaacagcctggaaccggaagattttgcggtgtattattgccagcagcgcgcgaactggccgcagaactttggcggcggcaccaaagtggaaattaaa

SEQ ID NO: 22121-22200 - skipped (80 entries)

SEQ ID NO: 22201 - protein, 454 aa, Artificial Sequence
  Description of Artificial Sequence: Synthetic polypeptide
EVQLVESGGGLVKPGGSLRLSCAASGFTFSSYYMNWVRQAPGKGLEWVSSISEDGYSTYYPDSLKGRFTISRDSAKNSLYLQMNSLRADDTAVYYCARDFSGHTAWAGTGFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 22202 - protein, 124 aa, Artificial Sequence; identical to SEQ ID NO: 21302
  Description of Artificial Sequence: Synthetic polypeptide

SEQ ID NO: 22203 - protein, 26 aa, Artificial Sequence
  Description of Artificial Sequence: Synthetic peptide
EVQLVESGGGLVKPGGSLRLSCAASG

SEQ ID NO: 22204 - protein, 9 aa, Artificial Sequence
  Description of Artificial Sequence: Synthetic peptide
FTFSSYYMN

SEQ ID NO: 22205 - protein, 14 aa, Artificial Sequence
  Description of Artificial Sequence: Synthetic peptide
WVRQAPGKGLEWVS

SEQ ID NO: 22206 - protein, 17 aa, Artificial Sequence
  Description of Artificial Sequence: Synthetic peptide
SISEDGYSTYYPDSLKG

SEQ ID NO: 22207 - protein, 30 aa, Artificial Sequence; identical to SEQ ID NO: 107
  Description of Artificial Sequence: Synthetic polypeptide

SEQ ID NO: 22208 - protein, 17 aa, Artificial Sequence
  Description of Artificial Sequence: Synthetic peptide
ARDFSGHTAWAGTGFEY

SEQ ID NO: 22209 - protein, 11 aa, Artificial Sequence
  Description of Artificial Sequence: Synthetic peptide
WGQGTLVTVSS

SEQ ID NO: 22210 - DNA, 372 bp, Artificial Sequence
  Description of Artificial Sequence: Synthetic polynucleotide
gaggtgcagctggtggagtctgggggaggcctggtcaagcctggggggtccctgagactttcctgtgcagcctctggattcaccttcagtagctattatatgaactgggtcagacaggctccagggaaggggctggagtgggtctcatccattagtgaggatggatacagtacatactaccctgactcacttaagggcagattcaccatctccagagacagtgccaagaactcactgtatctgcaaatgaacagcctgagagccgacgacacggctgtgtattactgtgccagagatttcagtggtcacaccgcttgggccggtacgggatttgaatactggggccaaggaaccctggtcaccgtctcctca

SEQ ID NO: 22211 - protein, 218 aa, Artificial Sequence
  Description of Artificial Sequence: Synthetic polypeptide
QSVLTQPPSVSGAPGQRITISCTGSSSNIGAGYDVHWYQQLPGTAPKLLIYGSSSRNSGVPDRFSGSKSGTSASLAITGLQAEDEADYYCQSYDSSLSVLYTFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 22212 - protein, 112 aa, Artificial Sequence
  Description of Artificial Sequence: Synthetic polypeptide
QSVLTQPPSVSGAPGQRITISCTGSSSNIGAGYDVHWYQQLPGTAPKLLIYGSSSRNSGVPDRFSGSKSGTSASLAITGLQAEDEADYYCQSYDSSLSVLYTFGTGTKVTVL

SEQ ID NO: 22213 - protein, 22 aa, Artificial Sequence
  Description of Artificial Sequence: Synthetic peptide
QSVLTQPPSVSGAPGQRITISC

SEQ ID NO: 22214 - protein, 14 aa, Artificial Sequence
  Description of Artificial Sequence: Synthetic peptide
TGSSSNIGAGYDVH

SEQ ID NO: 22215 - protein, 15 aa, Artificial Sequence
  Description of Artificial Sequence: Synthetic peptide
WYQQLPGTAPKLLIY

SEQ ID NO: 22216 - protein, 7 aa, Artificial Sequence
  Description of Artificial Sequence: Synthetic peptide
GSSSRNS

SEQ ID NO: 22217 - protein, 32 aa, Artificial Sequence; identical to SEQ ID NO: 117
  Description of Artificial Sequence: Synthetic polypeptide

SEQ ID NO: 22218 - protein, 12 aa, Artificial Sequence
  Description of Artificial Sequence: Synthetic peptide
QSYDSSLSVLYT

SEQ ID NO: 22219 - protein, 10 aa, Artificial Sequence
  Description of Artificial Sequence: Synthetic peptide
FGTGTKVTVL

SEQ ID NO: 22220 - DNA, 336 bp, Artificial Sequence
  Description of Artificial Sequence: Synthetic polynucleotide
cagtctgtgctgacgcagccgccctcagtgtctggggccccagggcagaggattaccatctcctgcactgggagcagctccaacatcggggcaggttatgatgtacactggtaccagcagcttccaggaacagcccccaaactgttgatctatggtagtagctccaggaattcaggggtccctgacagattctctggctccaagtctggcacctcagcctccctggccatcactgggttgcaggctgaggatgaggctgattattactgccaatcatacgacagctcactgtccgtgctttatacgttcggaactgggaccaaggtcaccgtcctg

SEQ ID NO: 22221-22300 - skipped (80 entries)

SEQ ID NO: 22301 - protein, 454 aa, Artificial Sequence
  Description of Artificial Sequence: Synthetic polypeptide
EVQLVESGGGLVKPGGSLRLSCAASGFTFSSYYMNWVRQAPGKGLEWVSSISEDGYSTYYPDSLKGRFTISRDSAKNSLYLQMNSLRADDTAVYYCARDFSGHTAWAGTGFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHYTQKSLSLSPGK

SEQ ID NO: 22302 - protein, 124 aa, Artificial Sequence; identical to SEQ ID NO: 21302
  Description of Artificial Sequence: Synthetic polypeptide

SEQ ID NO: 22303 - protein, 26 aa, Artificial Sequence
  Description of Artificial Sequence: Synthetic peptide
EVQLVESGGGLVKPGGSLRLSCAASG

SEQ ID NO: 22304 - protein, 9 aa, Artificial Sequence
  Description of Artificial Sequence: Synthetic peptide
FTFSSYYMN

SEQ ID NO: 22305 - protein, 14 aa, Artificial Sequence
  Description of Artificial Sequence: Synthetic peptide
WVRQAPGKGLEWVS

SEQ ID NO: 22306 - protein, 17 aa, Artificial Sequence
  Description of Artificial Sequence: Synthetic peptide
SISEDGYSTYYPDSLKG

SEQ ID NO: 22307 - protein, 30 aa, Artificial Sequence; identical to SEQ ID NO: 107
  Description of Artificial Sequence: Synthetic polypeptide

SEQ ID NO: 22308 - protein, 17 aa, Artificial Sequence
  Description of Artificial Sequence: Synthetic peptide
ARDFSGHTAWAGTGFEY

SEQ ID NO: 22309 - protein, 11 aa, Artificial Sequence
  Description of Artificial Sequence: Synthetic peptide
WGQGTLVTVSS

SEQ ID NO: 22310 - DNA, 372 bp, Artificial Sequence
  Description of Artificial Sequence: Synthetic polynucleotide
gaggtgcagctggtggagtctgggggaggcctggtcaagcctggggggtccctgagactgtcctgtgcagcctctggattcaccttcagtagctattatatgaactgggtcaggcaggctccagggaaggggctggagtgggtctcatccattagtgaggacggatacagcacctactaccccgactcactgaagggcagattcaccatctccagagacagcgccaagaactcactgtatctgcaaatgaacagcctgagagccgatgacacggctgtgtattactgtgccagagatttttcaggccacacggcgtgggcaggaacgggatttgagtactggggccaaggaaccctggtcaccgtctcctca

SEQ ID NO: 22311 - protein, 218 aa, Artificial Sequence; identical to SEQ ID NO: 22211
  Description of Artificial Sequence: Synthetic polypeptide

SEQ ID NO: 22312 - protein, 112 aa, Artificial Sequence; identical to SEQ ID NO: 22212
  Description of Artificial Sequence: Synthetic polypeptide

SEQ ID NO: 22313 - protein, 22 aa, Artificial Sequence
  Description of Artificial Sequence: Synthetic peptide
QSVLTQPPSVSGAPGQRITISC

SEQ ID NO: 22314 - protein, 14 aa, Artificial Sequence
  Description of Artificial Sequence: Synthetic peptide
TGSSSNIGAGYDVH

SEQ ID NO: 22315 - protein, 15 aa, Artificial Sequence
  Description of Artificial Sequence: Synthetic peptide
WYQQLPGTAPKLLIY

SEQ ID NO: 22316 - protein, 7 aa, Artificial Sequence
  Description of Artificial Sequence: Synthetic peptide
GSSSRNS

SEQ ID NO: 22317 - protein, 32 aa, Artificial Sequence; identical to SEQ ID NO: 117
  Description of Artificial Sequence: Synthetic polypeptide

SEQ ID NO: 22318 - protein, 12 aa, Artificial Sequence
  Description of Artificial Sequence: Synthetic peptide
QSYDSSLSVLYT

SEQ ID NO: 22319 - protein, 10 aa, Artificial Sequence
  Description of Artificial Sequence: Synthetic peptide
FGTGTKVTVL

SEQ ID NO: 22320 - DNA, 336 bp, Artificial Sequence
  Description of Artificial Sequence: Synthetic polynucleotide
cagtctgtgctgacgcagccgccctcagtgtctggggccccagggcagaggatcaccatctcctgcactgggagcagctccaacatcggggcaggttatgatgtacactggtaccagcagcttccaggaacagcccccaaacttctgatctatggttctagctccaggaactcaggggtccctgacaggttctctggctccaagtctggcacctcagcctccctggccatcactgggcttcaggctgaggatgaggctgattattactgccaaagttatgactctagtctgtccgtcttgtatacgttcggaactgggaccaaggtcaccgtcctg

SEQ ID NO: 22321-22400 - skipped (80 entries)

SEQ ID NO: 22401 - protein, 454 aa, Artificial Sequence
  Description of Artificial Sequence: Synthetic polypeptide
EVQLVESGGGLIQPGGSLRLSCAASGFPFKGTYMTWVRQAPGKGLEWVSIIYSGGDTYYADSVKGRFTISRDNSKNTLFLQMNSLRVEDTAMYYCARDREMAIITERTYGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 22402 - protein, 124 aa, Artificial Sequence
  Description of Artificial Sequence: Synthetic polypeptide
EVQLVESGGGLIQPGGSLRLSCAASGFPFKGTYMTWVRQAPGKGLEWVSIIYSGGDTYYADSVKGRFTISRDNSKNTLFLQMNSLRVEDTAMYYCARDREMAIITERTYGLDVWGQGTTVTVSS

SEQ ID NO: 22403 - protein, 26 aa, Artificial Sequence
  Description of Artificial Sequence: Synthetic peptide
EVQLVESGGGLIQPGGSLRLSCAASG

SEQ ID NO: 22404 - protein, 9 aa, Artificial Sequence
  Description of Artificial Sequence: Synthetic peptide
FPFKGTYMT

SEQ ID NO: 22405 - protein, 14 aa, Artificial Sequence
  Description of Artificial Sequence: Synthetic peptide
WVRQAPGKGLEWVS

SEQ ID NO: 22406 - protein, 16 aa, Artificial Sequence
  Description of Artificial Sequence: Synthetic peptide
IIYSGGDTYYADSVKG

SEQ ID NO: 22407 - protein, 30 aa, Artificial Sequence; identical to SEQ ID NO: 17507
  Description of Artificial Sequence: Synthetic polypeptide

SEQ ID NO: 22408 - protein, 18 aa, Artificial Sequence
  Description of Artificial Sequence: Synthetic peptide
ARDREMAIITERTYGLDV

SEQ ID NO: 22409 - protein, 11 aa, Artificial Sequence
  Description of Artificial Sequence: Synthetic peptide
WGQGTTVTVSS

SEQ ID NO: 22410 - DNA, 372 bp, Artificial Sequence
  Description of Artificial Sequence: Synthetic polynucleotide
gaggtgcagctggtggagtctggaggaggcttgatccagcctggggggtccctgagactgtcctgtgcagcctctgggttcccgtttaagggcacctacatgacctgggtcagacaggctccagggaaggggctggagtgggtctcaatcatttatagcggtggtgatacatactacgcagactccgtgaagggcagattcaccatctccagagacaattccaagaacacgctgttccttcaaatgaacagcctgagagtggaggacacggccatgtattactgtgccagggatagagagatggcgataatcacggaaaggacttacggtttggacgtctgggggcaagggaccacggtcaccgtctcctca

SEQ ID NO: 22411 - protein, 218 aa, Artificial Sequence
  Description of Artificial Sequence: Synthetic polypeptide
QSVLTQPPSASGTPGQRVTISCSGGSSNIGSNSVNWYQQLPGTAPKLLIYSNSQRPSGVPDRFSGSKSGTSASLAISGLQSEDEADYYCAAWDDSLNTFRYVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 22412 - protein, 112 aa, Artificial Sequence
  Description of Artificial Sequence: Synthetic polypeptide
QSVLTQPPSASGTPGQRVTISCSGGSSNIGSNSVNWYQQLPGTAPKLLIYSNSQRPSGVPDRFSGSKSGTSASLAISGLQSEDEADYYCAAWDDSLNTFRYVFGTGTKVTVL

SEQ ID NO: 22413 - protein, 22 aa, Artificial Sequence
  Description of Artificial Sequence: Synthetic peptide
QSVLTQPPSASGTPGQRVTISC

SEQ ID NO: 22414 - protein, 13 aa, Artificial Sequence
  Description of Artificial Sequence: Synthetic peptide
SGGSSNIGSNSVN

SEQ ID NO: 22415 - protein, 15 aa, Artificial Sequence
  Description of Artificial Sequence: Synthetic peptide
WYQQLPGTAPKLLIY

SEQ ID NO: 22416 - protein, 7 aa, Artificial Sequence
  Description of Artificial Sequence: Synthetic peptide
SNSQRPS

SEQ ID NO: 22417 - protein, 32 aa, Artificial Sequence; identical to SEQ ID NO: 17517
  Description of Artificial Sequence: Synthetic polypeptide

SEQ ID NO: 22418 - protein, 13 aa, Artificial Sequence
  Description of Artificial Sequence: Synthetic peptide
AAWDDSLNTFRYV

SEQ ID NO: 22419 - protein, 10 aa, Artificial Sequence
  Description of Artificial Sequence: Synthetic peptide
FGTGTKVTVL

SEQ ID NO: 22420 - DNA, 336 bp, Artificial Sequence
  Description of Artificial Sequence: Synthetic polynucleotide
cagtctgtgctgactcagccaccctcagcgtctgggacccccgggcagagggtcaccatctcttgttctggaggtagctccaacatcggaagtaattcagtaaactggtaccagcagttgccaggaacggcccccaaacttcttatctatagtaattctcagagaccctcaggggtccctgacaggttctctggctccaagtctggcacctcagcctccctggccatcagtgggttgcagtctgaggatgaggctgattattactgtgcagcatgggacgattccttgaatactttcagatatgtcttcggaactgggaccaaggtcaccgtcctg

SEQ ID NO: 22421-22500 - skipped (80 entries)

SEQ ID NO: 22501 - protein, 454 aa, Artificial Sequence
  Description of Artificial Sequence: Synthetic polypeptide
EVQLVESGGGLIQPGGSLRLSCAASGFPFKGTYMTWVRQAPGKGLEWVSIIYSGGDTYYADSVKGRFTISRDNSKNTLFLQMNSLRVEDTAMYYCARDREMAIITERTYGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHYTQKSLSLSPGK

SEQ ID NO: 22502 - protein, 124 aa, Artificial Sequence; identical to SEQ ID NO: 22402
  Description of Artificial Sequence: Synthetic polypeptide

SEQ ID NO: 22503 - protein, 26 aa, Artificial Sequence
  Description of Artificial Sequence: Synthetic peptide
EVQLVESGGGLIQPGGSLRLSCAASG

SEQ ID NO: 22504 - protein, 9 aa, Artificial Sequence
  Description of Artificial Sequence: Synthetic peptide
FPFKGTYMT

SEQ ID NO: 22505 - protein, 14 aa, Artificial Sequence
  Description of Artificial Sequence: Synthetic peptide
WVRQAPGKGLEWVS

SEQ ID NO: 22506 - protein, 16 aa, Artificial Sequence
  Description of Artificial Sequence: Synthetic peptide
IIYSGGDTYYADSVKG

SEQ ID NO: 22507 - protein, 30 aa, Artificial Sequence; identical to SEQ ID NO: 17507
  Description of Artificial Sequence: Synthetic polypeptide

SEQ ID NO: 22508 - protein, 18 aa, Artificial Sequence
  Description of Artificial Sequence: Synthetic peptide
ARDREMAIITERTYGLDV

SEQ ID NO: 22509 - protein, 11 aa, Artificial Sequence
  Description of Artificial Sequence: Synthetic peptide
WGQGTTVTVSS

SEQ ID NO: 22510 - DNA, 372 bp, Artificial Sequence
  Description of Artificial Sequence: Synthetic polynucleotide
gaggtgcagctggtggagtctggaggaggcttgatccagcctggggggtccctgagactgtcctgtgcagcctctgggttccccttcaagggaacttacatgacatgggtcaggcaggctccagggaaggggctggagtgggtctcaatcatttatagcggtggtgatacatactacgcagactccgtgaagggcagattcaccatctccagagacaattccaagaacacgctgttccttcaaatgaacagcctgagagtcgaggacacggccatgtattactgtgccagagatagggagatggcgatcattaccgagaggacgtacggtcttgacgtctgggggcaagggaccacggtcaccgtctcctca

SEQ ID NO: 22511 - protein, 218 aa, Artificial Sequence; identical to SEQ ID NO: 22411
  Description of Artificial Sequence: Synthetic polypeptide

SEQ ID NO: 22512 - protein, 112 aa, Artificial Sequence; identical to SEQ ID NO: 22412
  Description of Artificial Sequence: Synthetic polypeptide

SEQ ID NO: 22513 - protein, 22 aa, Artificial Sequence
  Description of Artificial Sequence: Synthetic peptide
QSVLTQPPSASGTPGQRVTISC

SEQ ID NO: 22514 - protein, 13 aa, Artificial Sequence
  Description of Artificial Sequence: Synthetic peptide
SGGSSNIGSNSVN

SEQ ID NO: 22515 - protein, 15 aa, Artificial Sequence
  Description of Artificial Sequence: Synthetic peptide
WYQQLPGTAPKLLIY

SEQ ID NO: 22516 - protein, 7 aa, Artificial Sequence
  Description of Artificial Sequence: Synthetic peptide
SNSQRPS

SEQ ID NO: 22517 - protein, 32 aa, Artificial Sequence; identical to SEQ ID NO: 17517
  Description of Artificial Sequence: Synthetic polypeptide

SEQ ID NO: 22518 - protein, 13 aa, Artificial Sequence
  Description of Artificial Sequence: Synthetic peptide
AAWDDSLNTFRYV

SEQ ID NO: 22519 - protein, 10 aa, Artificial Sequence
  Description of Artificial Sequence: Synthetic peptide
FGTGTKVTVL

SEQ ID NO: 22520 - DNA, 336 bp, Artificial Sequence
  Description of Artificial Sequence: Synthetic polynucleotide
cagtctgtgctgactcagccaccctcagcgtctgggacccccgggcagagggtcaccatctcttgttctggaggcagctccaacatcggaagtaatagcgtaaactggtaccagcagttgccaggaacggcccccaaattgttgatctatagtaatagtcagaggccctcaggggtccctgacagattctctggctccaagtctggcacctcagcctccctggccatcagtgggcttcagtctgaggatgaggctgattattactgtgctgcatgggacgattctttgaacactttcaggtatgtcttcggaactgggaccaaggtcaccgtcctt

SEQ ID NO: 22521-22600 - skipped (80 entries)

SEQ ID NO: 22601 - protein, 459 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFVTANYAQKFQGRVTITADKSTTTVYMELSSLRSEDTAVYYCARGRMATIRGGQNYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 22602 - protein, 129 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFVTANYAQKFQGRVTITADKSTTTVYMELSSLRSEDTAVYYCARGRMATIRGGQNYYYYYGMDVWGQGTTVTVSS

SEQ ID NO: 22603 - protein, 26 aa, Artificial Sequence
  Description of Artificial Sequence: Synthetic peptide
QVQLVQSGAEVKKPGSSVKVSCKASG

SEQ ID NO: 22604 - protein, 9 aa, Artificial Sequence
  Description of Artificial Sequence: Synthetic peptide
GTFSSYAIS

SEQ ID NO: 22605 - protein, 14 aa, Artificial Sequence
  Description of Artificial Sequence: Synthetic peptide
WVRQAPGQGLEWMG

SEQ ID NO: 22606 - protein, 17 aa, Artificial Sequence
  Description of Artificial Sequence: Synthetic peptide
GIIPIFVTANYAQKFQG

SEQ ID NO: 22607 - protein, 30 aa, Artificial Sequence; identical to SEQ ID NO: 21507
  Description of Artificial Sequence: Synthetic polypeptide

SEQ ID NO: 22608 - protein, 22 aa, Artificial Sequence
  Description of Artificial Sequence: Synthetic peptide
ARGRMATIRGGQNYYYYYGMDV

SEQ ID NO: 22609 - protein, 11 aa, Artificial Sequence
  Description of Artificial Sequence: Synthetic peptide
WGQGTTVTVSS

SEQ ID NO: 22610 - DNA, 387 bp, Artificial Sequence
  Description of Artificial Sequence: Synthetic polynucleotide
caggtgcagctggtgcagtctggggctgaggtgaagaagcctgggtccagcgtgaaggtctcctgcaaggcttctggaggcaccttcagcagctatgctatcagctgggtgaggcaggcccctggacaagggcttgagtggatgggagggatcatccctatctttgttacagcaaactacgcacagaagttccagggcagagtcacgattaccgcggacaaatccacgacaacagtatacatggagctgagcagcctgagatctgaggacacggccgtgtattactgtgctagaggaaggatggccacaataagaggcgggcagaactactactactactacggtatggacgtctgggggcaagggaccacggtcaccgtctcctca

SEQ ID NO: 22611 - protein, 214 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22612 - protein, 107 aa, Artificial Sequence; identical to SEQ ID NO: 21512
  Description of Artificial Sequence: Synthetic polypeptide

SEQ ID NO: 22613 - protein, 23 aa, Artificial Sequence
  Description of Artificial Sequence: Synthetic peptide
DIQMTQSPSSLSASVGDRVTITC

SEQ ID NO: 22614 - protein, 11 aa, Artificial Sequence
  Description of Artificial Sequence: Synthetic peptide
QASQDISNYLN

SEQ ID NO: 22615 - protein, 15 aa, Artificial Sequence
  Description of Artificial Sequence: Synthetic peptide
WYQQKPGKAPKLLIY

SEQ ID NO: 22616 - protein, 7 aa, Artificial Sequence
  Description of Artificial Sequence: Synthetic peptide
DASNLET

SEQ ID NO: 22617 - protein, 32 aa, Artificial Sequence; identical to SEQ ID NO: 21517
  Description of Artificial Sequence: Synthetic polypeptide

SEQ ID NO: 22618 - protein, 9 aa, Artificial Sequence
  Description of Artificial Sequence: Synthetic peptide
QQYDNLPLT

SEQ ID NO: 22619 - protein, 10 aa, Artificial Sequence
  Description of Artificial Sequence: Synthetic peptide
FGPGTKVDIK

SEQ ID NO: 22620 - DNA, 321 bp, Artificial Sequence
  Description of Artificial Sequence: Synthetic polynucleotide
gacatccagatgacccagtctccatcctccctgtctgcatctgtaggagacagagtcaccatcacttgccaggcgagtcaggacattagcaactatcttaattggtatcagcagaaaccagggaaagcccctaagttgctgatctacgatgcatccaatttggaaacaggggtcccatcaaggttcagtggaagtggatctgggacagattttactttcaccatcagcagcctgcagcctgaagatattgcaacatattactgtcaacaatacgataatctgcccttgactttcggccctgggaccaaagtggatatcaaa

SEQ ID NO: 22621-22700 - skipped (80 entries)

SEQ ID NO: 22701 - protein, 454 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSINYADSVKGRFTISRDNAKNSLYLQMNSLRAEDTALYYCASDSNYRDYYYHYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 22702 - protein, 124 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSINYADSVKGRFTISRDNAKNSLYLQMNSLRAEDTALYYCASDSNYRDYYYHYGMDVWGQGTTVTVSS

SEQ ID NO: 22703 - protein, 26 aa, Artificial Sequence
  Description of Artificial Sequence: Synthetic peptide
EVQLVESGGGLVQPGRSLRLSCAASG

SEQ ID NO: 22704 - protein, 9 aa, Artificial Sequence
  Description of Artificial Sequence: Synthetic peptide
FTFDDYAMH

SEQ ID NO: 22705 - protein, 14 aa, Artificial Sequence
  Description of Artificial Sequence: Synthetic peptide
WVRQAPGKGLEWVS

SEQ ID NO: 22706 - protein, 17 aa, Artificial Sequence
  Description of Artificial Sequence: Synthetic peptide
GISWNSGSINYADSVKG

SEQ ID NO: 22707 - protein, 30 aa, Artificial Sequence; identical to SEQ ID NO: 13807
  Description of Artificial Sequence: Synthetic polypeptide

SEQ ID NO: 22708 - protein, 17 aa, Artificial Sequence
  Description of Artificial Sequence: Synthetic peptide
ASDSNYRDYYYHYGMDV

SEQ ID NO: 22709 - protein, 11 aa, Artificial Sequence
  Description of Artificial Sequence: Synthetic peptide
WGQGTTVTVSS

SEQ ID NO: 22710 - DNA, 387 bp, Artificial Sequence
  Description of Artificial Sequence: Synthetic polynucleotide
caggtgcagctggtgcagtctggggctgaggtgaagaagcctgggtcctcagtgaaggtctcctgcaaggcttctggaggcaccttcagcagctatgctatcagctgggtgagacaggcccctggacaagggcttgagtggatgggagggatcatccctatctttgtaacagcaaactacgcacagaagttccagggcagagtcacgattaccgcggacaaatccacgacaacagtttacatggagctgagcagcctgagatctgaggacacggccgtgtattactgtgccagaggtaggatggccacgattaggggtggacagaattactactactactacggtatggacgtctgggggcaagggaccacggtcaccgtctcctca

SEQ ID NO: 22711 - protein, 219 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22712 - protein, 112 aa, Artificial Sequence; identical to SEQ ID NO: 21612
  Description of Artificial Sequence: Synthetic polypeptide

SEQ ID NO: 22713 - protein, 23 aa, Artificial Sequence
  Description of Artificial Sequence: Synthetic peptide
DIVMTQSPLSLPVTPGEPASISC

SEQ ID NO: 22714 - protein, 16 aa, Artificial Sequence
  Description of Artificial Sequence: Synthetic peptide
RSSQSLLHSNGYNYLD

SEQ ID NO: 22715 - protein, 15 aa, Artificial Sequence
  Description of Artificial Sequence: Synthetic peptide
WYLQKPGQSPQLLIY

SEQ ID NO: 22716 - protein, 7 aa, Artificial Sequence
  Description of Artificial Sequence: Synthetic peptide
LGSNRAS

SEQ ID NO: 22717 - protein, 32 aa, Artificial Sequence; identical to SEQ ID NO: 917
  Description of Artificial Sequence: Synthetic polypeptide

SEQ ID NO: 22718 - protein, 9 aa, Artificial Sequence
  Description of Artificial Sequence: Synthetic peptide
MQALQTPRT

SEQ ID NO: 22719 - protein, 10 aa, Artificial Sequence
  Description of Artificial Sequence: Synthetic peptide
FGQGTKVEIK

SEQ ID NO: 22720 - DNA, 321 bp, Artificial Sequence
  Description of Artificial Sequence: Synthetic polynucleotide
gacatccagatgacccagtctccatcctccctgtctgcatctgtaggagacagagtcaccatcacttgccaggcgagtcaggacattagcaactatttgaattggtatcagcagaaaccagggaaagcccctaagctgctgatctacgatgcatccaatttggaaacaggggtcccatcaaggttcagtggaagtggatctgggacagattttactttcaccatcagcagcctgcagcctgaagatattgcaacatattactgtcaacagtatgataacctgccgcttactttcggccctgggaccaaagtggatatcaaa

SEQ ID NO: 22721-22800 - skipped (80 entries)

SEQ ID NO: 22801 - protein, 459 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFVTANYAQKFQGRVTITADKSTTTVYMELSSLRSEDTAVYYCARGRMATIRGGQNYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHYTQKSLSLSPGK

SEQ ID NO: 22802 - protein, 129 aa, Artificial Sequence; identical to SEQ ID NO: 22602
  Description of Artificial Sequence: Synthetic polypeptide

SEQ ID NO: 22803 - protein, 26 aa, Artificial Sequence
  Description of Artificial Sequence: Synthetic peptide
QVQLVQSGAEVKKPGSSVKVSCKASG

SEQ ID NO: 22804 - protein, 9 aa, Artificial Sequence
  Description of Artificial Sequence: Synthetic peptide
GTFSSYAIS

SEQ ID NO: 22805 - protein, 14 aa, Artificial Sequence
  Description of Artificial Sequence: Synthetic peptide
WVRQAPGQGLEWMG

SEQ ID NO: 22806 - protein, 17 aa, Artificial Sequence
  Description of Artificial Sequence: Synthetic peptide
GIIPIFVTANYAQKFQG

SEQ ID NO: 22807 - protein, 30 aa, Artificial Sequence; identical to SEQ ID NO: 21507
  Description of Artificial Sequence: Synthetic polypeptide

SEQ ID NO: 22808 - protein, 22 aa, Artificial Sequence
  Description of Artificial Sequence: Synthetic peptide
ARGRMATIRGGQNYYYYYGMDV

SEQ ID NO: 22809 - protein, 11 aa, Artificial Sequence
  Description of Artificial Sequence: Synthetic peptide
WGQGTTVTVSS

SEQ ID NO: 22810 - DNA, 372 bp, Artificial Sequence
  Description of Artificial Sequence: Synthetic polynucleotide
gaagtgcagctggtggagtctgggggaggcttggtacagcctggcaggtccctgagactgtcctgtgcagcctctggattcacctttgatgattatgccatgcactgggtcagacaagctccagggaagggcctggagtgggtctcaggtattagttggaatagtggtagcataaattatgcggactctgtgaagggcaggttcaccatctccagagacaacgccaagaactccctgtatctgcaaatgaacagtctgagagctgaggacacggccttgtattactgtgcgtccgatagtaactatagggactactactaccattacggtatggacgtctgggggcaagggaccacggtcaccgtctcctca

SEQ ID NO: 22811 - protein, 214 aa, Artificial Sequence; identical to SEQ ID NO: 22611
  Description of Artificial Sequence: Synthetic polypeptide

SEQ ID NO: 22812 - protein, 107 aa, Artificial Sequence; identical to SEQ ID NO: 21512
  Description of Artificial Sequence: Synthetic polypeptide

SEQ ID NO: 22813 - protein, 23 aa, Artificial Sequence
  Description of Artificial Sequence: Synthetic peptide
DIQMTQSPSSLSASVGDRVTITC

SEQ ID NO: 22814 - protein, 11 aa, Artificial Sequence
  Description of Artificial Sequence: Synthetic peptide
QASQDISNYLN

SEQ ID NO: 22815 - protein, 15 aa, Artificial Sequence
  Description of Artificial Sequence: Synthetic peptide
WYQQKPGKAPKLLIY

SEQ ID NO: 22816 - protein, 7 aa, Artificial Sequence
  Description of Artificial Sequence: Synthetic peptide
DASNLET

SEQ ID NO: 22817 - protein, 32 aa, Artificial Sequence; identical to SEQ ID NO: 21517
  Description of Artificial Sequence: Synthetic polypeptide

SEQ ID NO: 22818 - protein, 9 aa, Artificial Sequence
  Description of Artificial Sequence: Synthetic peptide
QQYDNLPLT

SEQ ID NO: 22819 - protein, 10 aa, Artificial Sequence
  Description of Artificial Sequence: Synthetic peptide
FGPGTKVDIK

SEQ ID NO: 22820 - DNA, 336 bp, Artificial Sequence
  Description of Artificial Sequence: Synthetic polynucleotide
gatattgtgatgactcagtctccactttccctgcccgtcacccctggagagccggcctccatctcctgcaggtctagtcagagcctgctgcatagtaatggatacaactatttggattggtacctgcagaagccagggcagtctccacagcttctgatctatttgggttctaatagggcctccggggtccctgacaggttcagtggcagtggatcaggcacagattttacactgaaaatcagcagagtggaggctgaggatgttggggtttattactgcatgcaagccctgcagactccaaggacgttcggccaagggaccaaggtggaaatcaaa

SEQ ID NO: 22821-22900 - skipped (80 entries)

SEQ ID NO: 22901 - protein, 454 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSINYADSVKGRFTISRDNAKNSLYLQMNSLRAEDTALYYCASDSNYRDYYYHYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHYTQKSLSLSPGK

SEQ ID NO: 22902 - protein, 124 aa, Artificial Sequence; identical to SEQ ID NO: 22702
  Description of Artificial Sequence: Synthetic polypeptide

SEQ ID NO: 22903 - protein, 26 aa, Artificial Sequence
  Description of Artificial Sequence: Synthetic peptide
EVQLVESGGGLVQPGRSLRLSCAASG

SEQ ID NO: 22904 - protein, 9 aa, Artificial Sequence
  Description of Artificial Sequence: Synthetic peptide
FTFDDYAMH

SEQ ID NO: 22905 - protein, 14 aa, Artificial Sequence
  Description of Artificial Sequence: Synthetic peptide
WVRQAPGKGLEWVS

SEQ ID NO: 22906 - protein, 17 aa, Artificial Sequence
  Description of Artificial Sequence: Synthetic peptide
GISWNSGSINYADSVKG

SEQ ID NO: 22907 - protein, 30 aa, Artificial Sequence; identical to SEQ ID NO: 13807
  Description of Artificial Sequence: Synthetic polypeptide

SEQ ID NO: 22908 - protein, 17 aa, Artificial Sequence
  Description of Artificial Sequence: Synthetic peptide
ASDSNYRDYYYHYGMDV

SEQ ID NO: 22909 - protein, 11 aa, Artificial Sequence
  Description of Artificial Sequence: Synthetic peptide
WGQGTTVTVSS

SEQ ID NO: 22910 - DNA, 372 bp, Artificial Sequence
  Description of Artificial Sequence: Synthetic polynucleotide
gaagtgcagctggtggagtctgggggaggcttggtacagcctggcaggtccctgagattgtcctgtgcagcctctggattcacctttgatgattatgccatgcactgggtcaggcaagctccagggaagggcctggagtgggtctcaggtattagttggaatagtggtagcataaactatgcggactctgtgaagggcagattcaccatctccagagacaacgccaagaactccctgtatctgcaaatgaacagtctgagagctgaggacacggccttgtattactgtgcttctgatagtaattatagggactactactaccattacggtatggacgtctgggggcaagggaccacggtcaccgtctcctca

SEQ ID NO: 22911 - protein, 219 aa, Artificial Sequence; identical to SEQ ID NO: 22711
  Description of Artificial Sequence: Synthetic polypeptide

SEQ ID NO: 22912 - protein, 112 aa, Artificial Sequence; identical to SEQ ID NO: 21612
  Description of Artificial Sequence: Synthetic polypeptide

SEQ ID NO: 22913 - protein, 23 aa, Artificial Sequence
  Description of Artificial Sequence: Synthetic peptide
DIVMTQSPLSLPVTPGEPASISC

SEQ ID NO: 22914 - protein, 16 aa, Artificial Sequence
  Description of Artificial Sequence: Synthetic peptide
RSSQSLLHSNGYNYLD

SEQ ID NO: 22915 - protein, 15 aa, Artificial Sequence
  Description of Artificial Sequence: Synthetic peptide
WYLQKPGQSPQLLIY

SEQ ID NO: 22916 - protein, 7 aa, Artificial Sequence
  Description of Artificial Sequence: Synthetic peptide
LGSNRAS

SEQ ID NO: 22917 - protein, 32 aa, Artificial Sequence; identical to SEQ ID NO: 917
  Description of Artificial Sequence: Synthetic polypeptide

SEQ ID NO: 22918 - protein, 9 aa, Artificial Sequence
  Description of Artificial Sequence: Synthetic peptide
MQALQTPRT

SEQ ID NO: 22919 - protein, 10 aa, Artificial Sequence
  Description of Artificial Sequence: Synthetic peptide
FGQGTKVEIK

SEQ ID NO: 22920 - DNA, 336 bp, Artificial Sequence
  Description of Artificial Sequence: Synthetic polynucleotide
gatattgtgatgactcagtctccactgtccctgcccgtcacccctggagagccggcctccatctcctgcaggtctagtcagagcctgctgcatagtaatggatacaactatttggattggtacctgcagaagccagggcagtctccacagcttctgatctatttgggttctaatagagcctccggggtccctgacaggttcagtggcagtggatcaggcacagattttacactgaaaatcagcagagtggaggctgaggatgttggggtttattactgcatgcaggctttgcagacacctagaacgttcggccaagggaccaaggtggaaatcaaa

SEQ ID NO: 22921-23000 - skipped (80 entries)

SEQ ID NO: 23001 - protein, 454 aa, Artificial Sequence; identical to SEQ ID NO: 22701
  Description of Artificial Sequence: Synthetic polypeptide

SEQ ID NO: 23002 - protein, 124 aa, Artificial Sequence; identical to SEQ ID NO: 22702
  Description of Artificial Sequence: Synthetic polypeptide

SEQ ID NO: 23003 - protein, 26 aa, Artificial Sequence
  Description of Artificial Sequence: Synthetic peptide
EVQLVESGGGLVQPGRSLRLSCAASG

SEQ ID NO: 23004 - protein, 9 aa, Artificial Sequence
  Description of Artificial Sequence: Synthetic peptide
FTFDDYAMH

SEQ ID NO: 23005 - protein, 14 aa, Artificial Sequence
  Description of Artificial Sequence: Synthetic peptide
WVRQAPGKGLEWVS

SEQ ID NO: 23006 - protein, 17 aa, Artificial Sequence
  Description of Artificial Sequence: Synthetic peptide
GISWNSGSINYADSVKG

SEQ ID NO: 23007 - protein, 30 aa, Artificial Sequence; identical to SEQ ID NO: 13807
  Description of Artificial Sequence: Synthetic polypeptide

SEQ ID NO: 23008 - protein, 17 aa, Artificial Sequence
  Description of Artificial Sequence: Synthetic peptide
ASDSNYRDYYYHYGMDV

SEQ ID NO: 23009 - protein, 11 aa, Artificial Sequence
  Description of Artificial Sequence: Synthetic peptide
WGQGTTVTVSS

SEQ ID NO: 23010 - DNA, 372 bp, Artificial Sequence; identical to SEQ ID NO: 22810
  Description of Artificial Sequence: Synthetic polynucleotide

SEQ ID NO: 23011 - protein, 219 aa, Artificial Sequence
  Description of Artificial Sequence: Synthetic polypeptide
DIVMTQSPLSLPVTPGEPASISCRSSQSLLHSQGYNYLDWYLQKPGQSPQLLIYLGSNRASGVPDRFSGSGSGTDFTLKISRVEAEDVGVYYCMQALQTPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 23012 - protein, 112 aa, Artificial Sequence
  Description of Artificial Sequence: Synthetic polypeptide
DIVMTQSPLSLPVTPGEPASISCRSSQSLLHSQGYNYLDWYLQKPGQSPQLLIYLGSNRASGVPDRFSGSGSGTDFTLKISRVEAEDVGVYYCMQALQTPRTFGQGTKVEIK

SEQ ID NO: 23013 - protein, 23 aa, Artificial Sequence
  Description of Artificial Sequence: Synthetic peptide
DIVMTQSPLSLPVTPGEPASISC

SEQ ID NO: 23014 - protein, 16 aa, Artificial Sequence
  Description of Artificial Sequence: Synthetic peptide
RSSQSLLHSQGYNYLD

SEQ ID NO: 23015 - protein, 15 aa, Artificial Sequence
  Description of Artificial Sequence: Synthetic peptide
WYLQKPGQSPQLLIY

SEQ ID NO: 23016 - protein, 7 aa, Artificial Sequence
  Description of Artificial Sequence: Synthetic peptide
LGSNRAS

SEQ ID NO: 23017 - protein, 32 aa, Artificial Sequence; identical to SEQ ID NO: 917
  Description of Artificial Sequence: Synthetic polypeptide

SEQ ID NO: 23018 - protein, 9 aa, Artificial Sequence
  Description of Artificial Sequence: Synthetic peptide
MQALQTPRT

SEQ ID NO: 23019 - protein, 10 aa, Artificial Sequence
  Description of Artificial Sequence: Synthetic peptide
FGQGTKVEIK

SEQ ID NO: 23020 - DNA, 336 bp, Artificial Sequence; identical to SEQ ID NO: 22820
  Description of Artificial Sequence: Synthetic polynucleotide

SEQ ID NO: 23021-23100 - skipped (80 entries)

SEQ ID NO: 23101 - protein, 454 aa, Artificial Sequence; identical to SEQ ID NO: 22901
  Description of Artificial Sequence: Synthetic polypeptide

SEQ ID NO: 23102 - protein, 124 aa, Artificial Sequence; identical to SEQ ID NO: 22702
  Description of Artificial Sequence: Synthetic polypeptide

SEQ ID NO: 23103 - protein, 26 aa, Artificial Sequence
  Description of Artificial Sequence: Synthetic peptide
EVQLVESGGGLVQPGRSLRLSCAASG

SEQ ID NO: 23104 - protein, 9 aa, Artificial Sequence
  Description of Artificial Sequence: Synthetic peptide
FTFDDYAMH

SEQ ID NO: 23105 - protein, 14 aa, Artificial Sequence
  Description of Artificial Sequence: Synthetic peptide
WVRQAPGKGLEWVS

SEQ ID NO: 23106 - protein, 17 aa, Artificial Sequence
  Description of Artificial Sequence: Synthetic peptide
GISWNSGSINYADSVKG

SEQ ID NO: 23107 - protein, 30 aa, Artificial Sequence; identical to SEQ ID NO: 13807
  Description of Artificial Sequence: Synthetic polypeptide

SEQ ID NO: 23108 - protein, 17 aa, Artificial Sequence
  Description of Artificial Sequence: Synthetic peptide
ASDSNYRDYYYHYGMDV

SEQ ID NO: 23109 - protein, 11 aa, Artificial Sequence
  Description of Artificial Sequence: Synthetic peptide
WGQGTTVTVSS

SEQ ID NO: 23110 - DNA, 372 bp, Artificial Sequence
  Description of Artificial Sequence: Synthetic polynucleotide
gaagtccaattggtagagagtggcggagggctggtgcagccaggcaggagtttgaggctgagctgtgccgccagtggttttacgttcgacgattacgcaatgcactgggtcagacaggcgcccggaaagggtctggaatgggttagtgggatttcatggaattcaggttcaattaactatgctgacagcgtcaaagggagatttacaatctccagggacaacgctaaaaatagtctttatctgcagatgaactccttgagagcagaggatacagcactgtactactgcgctagtgatagcaattacagggactactactaccattatgggatggacgtgtgggggcagggtacgactgtgactgtcagcagt

SEQ ID NO: 23111 - protein, 219 aa, Artificial Sequence; identical to SEQ ID NO: 23011
  Description of Artificial Sequence: Synthetic polypeptide

SEQ ID NO: 23112 - protein, 112 aa, Artificial Sequence; identical to SEQ ID NO: 23012
  Description of Artificial Sequence: Synthetic polypeptide

SEQ ID NO: 23113 - protein, 23 aa, Artificial Sequence
  Description of Artificial Sequence: Synthetic peptide
DIVMTQSPLSLPVTPGEPASISC

SEQ ID NO: 23114 - protein, 16 aa, Artificial Sequence
  Description of Artificial Sequence: Synthetic peptide
RSSQSLLHSQGYNYLD

SEQ ID NO: 23115 - protein, 15 aa, Artificial Sequence
  Description of Artificial Sequence: Synthetic peptide
WYLQKPGQSPQLLIY

SEQ ID NO: 23116 - protein, 7 aa, Artificial Sequence
  Description of Artificial Sequence: Synthetic peptide
LGSNRAS

SEQ ID NO: 23117 - protein, 32 aa, Artificial Sequence; identical to SEQ ID NO: 917
  Description of Artificial Sequence: Synthetic polypeptide

SEQ ID NO: 23118 - protein, 9 aa, Artificial Sequence
  Description of Artificial Sequence: Synthetic peptide
MQALQTPRT

SEQ ID NO: 23119 - protein, 10 aa, Artificial Sequence
  Description of Artificial Sequence: Synthetic peptide
FGQGTKVEIK

SEQ ID NO: 23120 - DNA, 336 bp, Artificial Sequence
  Description of Artificial Sequence: Synthetic polynucleotide
gacattgtaatgacgcagagtcctctttctcttccggtcactccgggagaaccggctagcatatcctgtagatctagccagtccctgcttcactcacagggatacaactacctggattggtaccttcaaaaaccgggtcagagcccccaattgctgatatacttgggatctaatagagcgagcggagtgccagatagattttctggaagcgggtcaggcaccgattttacattgaagatatcaagggtagaggctgaagacgtgggagtttattattgcatgcaggcccttcaaaccccaaggacgttcgggcaaggaacaaaggtggagatcaaa

SEQ ID NO: 23121 - protein, 22 aa, Artificial Sequence
  Description of Artificial Sequence: Synthetic peptide
IRDADPFAAAFANNNFFFAIDI

SEQ ID NO: 23122 - protein, 22 aa, Artificial Sequence
  Description of Artificial Sequence: Synthetic peptide
IRDADPFAAAARNNNFFFGIDI

SEQ ID NO: 23123 - protein, 17 aa, Artificial Sequence
  Description of Artificial Sequence: Synthetic peptide
ARAAPPGGAAGFPFIDI

SEQ ID NO: 23124 - protein, 17 aa, Artificial Sequence
  Description of Artificial Sequence: Synthetic peptide
IRAAPPGGNAGFPFFDD

SEQ ID NO: 23125 - protein, 17 aa, Artificial Sequence
  Description of Artificial Sequence: Synthetic peptide
ARAAPPGGGAGFPFFDF

SEQ ID NO: 23126 - protein, 17 aa, Artificial Sequence
  Description of Artificial Sequence: Synthetic peptide
ARDFAGNAAIAGAGFDF

SEQ ID NO: 23127 - protein, 17 aa, Artificial Sequence
  Description of Artificial Sequence: Synthetic peptide
ARDFPGDAAIAGAGFNF

SEQ ID NO: 23128 - protein, 23 aa, Artificial Sequence
  Description of Artificial Sequence: Synthetic peptide
ARGAIARDFDFIAAPNNGPFFDA

SEQ ID NO: 23129 - protein, 18 aa, Artificial Sequence
  Description of Artificial Sequence: Synthetic peptide
AADFFDGRAFNAFIGIDI

SEQ ID NO: 23130 - protein, 17 aa, Artificial Sequence
  Description of Artificial Sequence: Synthetic peptide
ARDDFAGAINNFFGIDI

SEQ ID NO: 23131 - protein, 17 aa, Artificial Sequence
  Description of Artificial Sequence: Synthetic peptide
ARDDPAGAFNNFFGIDI

SEQ ID NO: 23132 - protein, 18 aa, Artificial Sequence
  Description of Artificial Sequence: Synthetic peptide
ARDNIINNNADNIGFFDF

SEQ ID NO: 23133 - protein, 21 aa, Artificial Sequence
  Description of Artificial Sequence: Synthetic peptide
ARIDIIRFFDFIGDDNNFFDP

SEQ ID NO: 23134 - protein, 20 aa, Artificial Sequence
  Description of Artificial Sequence: Synthetic peptide
ARIGFIRFFDFARPFFFFDI

SEQ ID NO: 23135 - protein, 13 aa, Artificial Sequence
  Description of Artificial Sequence: Synthetic peptide
ARIGPFGAGAFDF

SEQ ID NO: 23136 - protein, 17 aa, Artificial Sequence
  Description of Artificial Sequence: Synthetic peptide
IIDAAAANPNNFFGIDI

SEQ ID NO: 23137 - protein, 17 aa, Artificial Sequence
  Description of Artificial Sequence: Synthetic peptide
IIDAAIADPNNFFGIDI

SEQ ID NO: 23138 - protein, 15 aa, Artificial Sequence
  Description of Artificial Sequence: Synthetic peptide
IRDGAFDAAGFFAAN

SEQ ID NO: 23139 - protein, 23 aa, Artificial Sequence
  Description of Artificial Sequence: Synthetic peptide
AARIRGAANFDFFAGFFAGPFDI

SEQ ID NO: 23140 - protein, 15 aa, Artificial Sequence
  Description of Artificial Sequence: Synthetic peptide
AGRNNDIIPIGAFDI

SEQ ID NO: 23141 - protein, 17 aa, Artificial Sequence
  Description of Artificial Sequence: Synthetic peptide
ANAADIPPRRPFAAFDF

SEQ ID NO: 23142 - protein, 8 aa, Artificial Sequence
  Description of Artificial Sequence: Synthetic peptide
ANANFIDF

SEQ ID NO: 23143 - protein, 19 aa, Artificial Sequence
  Description of Artificial Sequence: Synthetic peptide
ARANANDFFAGFFAAAFDI

SEQ ID NO: 23144 - protein, 14 aa, Artificial Sequence
  Description of Artificial Sequence: Synthetic peptide
ARARGGAFANAFDF

SEQ ID NO: 23145 - protein, 20 aa, Artificial Sequence
  Description of Artificial Sequence: Synthetic peptide
ARDFGIRFDDARNIIRFIDA

SEQ ID NO: 23146 - protein, 17 aa, Artificial Sequence
  Description of Artificial Sequence: Synthetic peptide
ARDGAAIGFFFFFAIDI

SEQ ID NO: 23147 - protein, 9 aa, Artificial Sequence
  Description of Artificial Sequence: Synthetic peptide
ARDIPPIDF

SEQ ID NO: 23148 - protein, 19 aa, Artificial Sequence
  Description of Artificial Sequence: Synthetic peptide
ARDIRRGFFDANGNNNFDI

SEQ ID NO: 23149 - protein, 16 aa, Artificial Sequence
  Description of Artificial Sequence: Synthetic peptide
ARDNAINNGRPGFFDA

SEQ ID NO: 23150 - protein, 29 aa, Artificial Sequence
  Description of Artificial Sequence: Synthetic peptide
ARDPGPIAFFDFAPDRARRAFFDFNGIDI

SEQ ID NO: 23151 - protein, 15 aa, Artificial Sequence
  Description of Artificial Sequence: Synthetic peptide
ARDRDIPGRGGFFDN

SEQ ID NO: 23152 - protein, 18 aa, Artificial Sequence
  Description of Artificial Sequence: Synthetic peptide
ARDRRAFGPNFFFGAGDD

SEQ ID NO: 23153 - protein, 23 aa, Artificial Sequence
  Description of Artificial Sequence: Synthetic peptide
ARGFAAPIIRDIPIAFRPRFFDP

SEQ ID NO: 23154 - protein, 18 aa, Artificial Sequence
  Description of Artificial Sequence: Synthetic peptide
ARGNDAPIIGIAGRFFDP

SEQ ID NO: 23155 - protein, 15 aa, Artificial Sequence
  Description of Artificial Sequence: Synthetic peptide
ARGPIRNFGIDAFDI

SEQ ID NO: 23156 - protein, 23 aa, Artificial Sequence
  Description of Artificial Sequence: Synthetic peptide
ARIRIGAANNNFFAGFFADAFDI

SEQ ID NO: 23157 - protein, 19 aa, Artificial Sequence
  Description of Artificial Sequence: Synthetic peptide
ARRGAPFIGIDIFRGFFDF

SEQ ID NO: 23158 - protein, 17 aa, Artificial Sequence
  Description of Artificial Sequence: Synthetic peptide
ARRGNNFGFFFFFAIDI

SEQ ID NO: 23159 - protein, 10 aa, Artificial Sequence
  Description of Artificial Sequence: Synthetic peptide
IRDADFAFDA

SEQ ID NO: 23160 - protein, 14 aa, Artificial Sequence
  Description of Artificial Sequence: Synthetic peptide
IRDGGFFDAAGPGN

SEQ ID NO: 23161 - protein, 14 aa, Artificial Sequence
  Description of Artificial Sequence: Synthetic peptide
IRDGNNFIGIFFDN

SEQ ID NO: 23162 - protein, 15 aa, Artificial Sequence
  Description of Artificial Sequence: Synthetic peptide
IRDIGAAIAFDIFDI

SEQ ID NO: 23163 - protein, 18 aa, Artificial Sequence
  Description of Artificial Sequence: Synthetic peptide
IRDNIIIPGAIIRPNFDF

SEQ ID NO: 23164 - protein, 20 aa, Artificial Sequence
  Description of Artificial Sequence: Synthetic peptide
IRNRFIAGGAIFIFDDAFDI

SEQ ID NO: 23165 - protein, 6 aa, Artificial Sequence
  Description of Artificial Sequence: Synthetic peptide
SSDGYN

SEQ ID NO: 23166 - protein, 6 aa, Artificial Sequence
  Description of Artificial Sequence: Synthetic peptide
SEDGYS

SEQ ID NO: 23167 - protein, 6 aa, Artificial Sequence
  Description of Artificial Sequence: Synthetic peptide
EVQLLE

SEQ ID NO: 23168 - protein, 6 aa, Artificial Sequence
  Description of Artificial Sequence: Synthetic peptide
QVQLVQ

SEQ ID NO: 23169-23175 - skipped (7 entries)

SEQ ID NO: 23176 - protein, 105 aa, Severe acute respiratory syndrome coronavirus 2
IRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQ

SEQ ID NO: 23177 - protein, 105 aa, Unknown
  Description of Unknown: GD-Pangolin sequence
VRGDEVRQIAPGQTGRIADYNYKLPDDFTGCVIAWNSNNLDSKVGGNYNYLYRLFRKSNLKPFERDISTEIYQAGSTPCNGVEGFNCYFPLQSYGFHPTNGVGYQ

SEQ ID NO: 23178 - protein, 105 aa, Unknown
  Description of Unknown: RaTG13 sequence
ITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQ

SEQ ID NO: 23179 - protein, 105 aa, Unknown
  Description of Unknown: Pangolin_GX-P2V sequence
VKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQ

SEQ ID NO: 23180 - protein, 104 aa, Unknown
  Description of Unknown: Rs4231 sequence
VKGDDVRQIAPGQTGVIADYNYKLPDDFLGCVLAWNTNSKDSSTSGNYNYLYRWVRRSKLNPYERDLSNDIYSPGGQSCSAIGPNCYNPLRPYGFFTTAGVGHQ

SEQ ID NO: 23181 - protein, 104 aa, Unknown
  Description of Unknown: RsSHC014 sequence
VKGDDVRQIAPGQTGVIADYNYKLPDDFLGCVLAWNTNSKDSSTSGNYNYLYRWVRRSKLNPYERDLSNDIYSPGGQSCSAVGPNCYNPLRPYGFFTTAGVGHQ

SEQ ID NO: 23182 - protein, 104 aa, Unknown
  Description of Unknown: A021 sequence
VKGDDVRQIAPGQTGVIADYNYKLPDDFMGCVLAWNTRNIDATSTGNYNYKYRYLRHGKLRPFERDISNVPFSSDGKPCTPPAPNCYWPLRGYGFYTTSGIGYQ

SEQ ID NO: 23183 - protein, 104 aa, Unknown
  Description of Unknown: Civet 007-2004 sequence
VKGDDVRQIAPGQTGVIADYNYKLPDDFMGCVLAWNTRNIDATSTGNYNYKYRYLRHGKLRPFERDISNVPFSPDGKPCTPPAPNCYWPLNGYGFYTTSGIGYQ

SEQ ID NO: 23184 - protein, 104 aa, Unknown
  Description of Unknown: CS24 sequence
VKGDDVRQIAPGQTGVIADYNYKLPDDFMGCVLAWNTRNIDATSTGNYNYKYRYLRHGKLRPFERDISNVPFSPDGKPCTPPAPNCYWPLNDYGFYTTSGIGYQ

SEQ ID NO: 23185 - protein, 104 aa, Severe acute respiratory syndrome coronavirus 1
VKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQ

SEQ ID NO: 23186 - protein, 104 aa, Unknown
  Description of Unknown: Frankfurt 1 sequence
VKGDDVRQIAPGQTGVIADYNYKLPDDFMGCVLAWNTRNIDATSTGNYNYKYRCLRHGKLRPFERDISNVPFSPDGKPCTPPAFNCYWPLNDYGFYTTTGIGYQ

SEQ ID NO: 23187 - protein, 104 aa, Unknown
  Description of Unknown: WIV1 sequence
VKGDDVRQIAPGQTGVIADYNYKLPDDFTGCVLAWNTRNIDATQTGNYNYKYRSLRHGKLRPFERDISNVPFSPDGKPCTPPAFNCYWPLNDYGFYITNGIGYQ

SEQ ID NO: 23188 - protein, 104 aa, Unknown
  Description of Unknown: LYRa11 sequence
VKGDDVRQIAPGQTGVIADYNYKLPDDFMGCVLAWNTRNIDATSSGNFNYKYRSLRHGKLRPFERDISNVPFSPDGKPCTPPAFNCYWPLNDYGFYTTNGIGYQ

SEQ ID NO: 23189 - protein, 86 aa, Unknown
  Description of Unknown: R11-2004 sequence
IRFSEVRQVAPGQTGVIADYNYKLPDDFTGCVIAWNTAKQDVGSYFYRSHRSSKLKPFERDLSSEENGVRTLSTYDFNQNVPLEYQ

SEQ ID NO: 23190 - protein, 87 aa, Unknown
  Description of Unknown: HKU3 sequence
IRSSEVRQVAPGETGVIADYNYKLPDDFTGCVIAWNTAKHDTGNYYYRSHRKTKLKPFERDLSSDDGNGVYTLSTYDFNPNVPVAYQ

SEQ ID NO: 23191 - protein, 86 aa, Unknown
  Description of Unknown: Rs4081 sequence
IRSSEVRQVAPGETGVIADYNYKLPDDFTGCVIAWNTAKQDQGQYYYRSSRKTKLKPFERDLTSDENGVRTLSTYDFYPNVPIEYQ

SEQ ID NO: 23192 - protein, 100 aa, Unknown
  Description of Unknown: BM48-31 sequence
VKGDDVRQIAPAQTGVIADYNYKLPDDFTGCVIAWNTNSLDSSNEFFYRRFRHGKIKPYGRDLSNVLFNPSGGTCSAEGLNCYKPLASYGFTQSSGIGFQ

SEQ ID NO: 23193 - RNA, 2000 nt, Artificial Sequence
  Description of Artificial Sequence: Synthetic polynucleotide
  misc_feature (1)..(2000): This sequence may encompass 50-2000 nucleotides
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23194 - protein, 5 aa, Artificial Sequence
  Description of Artificial Sequence: Synthetic peptide
GGGGS

SEQ ID NO: 23195 - protein, 10 aa, Artificial Sequence
  Description of Artificial Sequence: Synthetic peptide
GGGGSGGGGS

SEQ ID NO: 23196 - protein, 4 aa, Artificial Sequence
  Description of Artificial Sequence: Synthetic peptide
GSAS

SEQ ID NO: 23197 - protein, 8 aa, Artificial Sequence
  Description of Artificial Sequence: Synthetic peptide
HHHHHHHH

SEQ ID NO: 23198 - protein, 19 aa, Artificial Sequence
  Description of Artificial Sequence: Synthetic peptide
ARDPAINFAGNNNFFDIDI

SEQ ID NO: 23199 - protein, 19 aa, Artificial Sequence
  Description of Artificial Sequence: Synthetic peptide
ARDPAIINAGNNNFFDIDI

SEQ ID NO: 23200 - protein, 19 aa, Artificial Sequence
  Description of Artificial Sequence: Synthetic peptide
ARDPAFINAGNNFFFAIDI

SEQ ID NO: 23201 - protein, 19 aa, Artificial Sequence
  Description of Artificial Sequence: Synthetic peptide
ARDPAFINAGNNFFFDFDI

SEQ ID NO: 23202 - protein, 22 aa, Artificial Sequence
  Description of Artificial Sequence: Synthetic peptide
IRDADPFAAAIAANNFFFAIDI

SEQ ID NO: 23203 - protein, 22 aa, Artificial Sequence
  Description of Artificial Sequence: Synthetic peptide
IRDADPFAAAFRNNNFFFAIDI

SEQ ID NO: 23204 - protein, 22 aa, Artificial Sequence
  Description of Artificial Sequence: Synthetic peptide
IRDADPFAAAIRNNNFFFAIDI

SEQ ID NO: 23205 - protein, 9 aa, Artificial Sequence
  Description of Artificial Sequence: Synthetic peptide
  MOD_RES (1)..(1): F or Y
  MOD_RES (2)..(2): T or S
  MOD_RES (4)..(4): S or T
  MOD_RES (5)..(5): S, R, G, H, T, A, or K
  MOD_RES (6)..(6): F or Y
  MOD_RES (7)..(7): Y, A, D, G, P, or V
  MOD_RES (8)..(8): M or I
  MOD_RES (9)..(9): H or N
XXFXXXXXX

SEQ ID NO: 23206 - protein, 9 aa, Artificial Sequence
  Description of Artificial Sequence: Synthetic peptide
  MOD_RES (1)..(1): F or Y
  MOD_RES (4)..(4): T or S
  MOD_RES (8)..(8): M or I
  MOD_RES (9)..(9): H or N
XTFXSYYXX

SEQ ID NO: 23207 - protein, 9 aa, Artificial Sequence
  Description of Artificial Sequence: Synthetic peptide
FTFSSYYMN

SEQ ID NO: 23208 - protein, 17 aa, Artificial Sequence
  Description of Artificial Sequence: Synthetic peptide
  MOD_RES (4)..(4): S or E
  MOD_RES (8)..(8): N or S
SISXDGYXTYYPDSLKG

SEQ ID NO: 23209 - protein, 17 aa, Artificial Sequence
  Description of Artificial Sequence: Synthetic peptide
  MOD_RES (10)..(10): W or V
ARDFSGHTAXAGTGFEY

SEQ ID NO: 23210 - protein, 14 aa, Artificial Sequence
  Description of Artificial Sequence: Synthetic peptide
  MOD_RES (4)..(4): N or S
  MOD_RES (7)..(7): I or V
  MOD_RES (12)..(12): D or Y
TSGXSNXGAGYXVH

SEQ ID NO: 23211 - protein, 7 aa, Artificial Sequence
  Description of Artificial Sequence: Synthetic peptide
  MOD_RES (2)..(2): A, S, or T
  MOD_RES (3)..(3): S or T
  MOD_RES (4)..(4): S, T, A, or N
  MOD_RES (5)..(5): R, L, or T
  MOD_RES (6)..(6): A, P, Q, H, or N
  MOD_RES (7)..(7): T or S
GXXXXXX

SEQ ID NO: 23212 - protein, 7 aa, Artificial Sequence
  Description of Artificial Sequence: Synthetic peptide
  MOD_RES (2)..(2): S or A
  MOD_RES (5)..(5): R or L
  MOD_RES (6)..(6): N, H, or Q
GXSSXXS

SEQ ID NO: 23213 - protein, 7 aa, Artificial Sequence
  Description of Artificial Sequence: Synthetic peptide
GSSSRNS

SEQ ID NO: 23214 - protein, 12 aa, Artificial Sequence
  Description of Artificial Sequence: Synthetic peptide
  MOD_RES (12)..(12): T or V
QSYDSSLSVLYX

SEQ ID NO: 23215 - protein, 9 aa, Artificial Sequence
  Description of Artificial Sequence: Synthetic peptide
  MOD_RES (5)..(5): R or K
  MOD_RES (6)..(6): F or Y
FTFSXXAMH

SEQ ID NO: 23216 - protein, 9 aa, Artificial Sequence
  Description of Artificial Sequence: Synthetic peptide
FTFSRFAMH

SEQ ID NO: 23217 - protein, 17 aa, Artificial Sequence
  Description of Artificial Sequence: Synthetic peptide
  MOD_RES (9)..(9): K or T
AINLNGDSXYYTDSVRG

SEQ ID NO: 23218 - protein, 14 aa, Artificial Sequence
  Description of Artificial Sequence: Synthetic peptide
VKDGGYYDSSGPGH

SEQ ID NO: 23219 - protein, 11 aa, Artificial Sequence
  Description of Artificial Sequence: Synthetic peptide
  MOD_RES (4)..(4): E or Q
  MOD_RES (6)..(6): I or V
  MOD_RES (7)..(7): L, A, or N
  MOD_RES (8)..(8): H or N
  MOD_RES (9)..(9): Y or W
RASXNXXXXLA

SEQ ID NO: 23220 - protein, 11 aa, Artificial Sequence
  Description of Artificial Sequence: Synthetic peptide
  MOD_RES (7)..(7): L or A
RASENIXHYLA

SEQ ID NO: 23221 - protein, 11 aa, Artificial Sequence
  Description of Artificial Sequence: Synthetic peptide
RASENILHYLA

SEQ ID NO: 23222 - protein, 7 aa, Artificial Sequence
  Description of Artificial Sequence: Synthetic peptide
  MOD_RES (1)..(1): D or E
  MOD_RES (2)..(2): A, S, T, or V
  MOD_RES (3)..(3): S or F
  MOD_RES (4)..(4): S, A, T, K, N, or R
  MOD_RES (6)..(6): A or V
  MOD_RES (7)..(7): T, S, or P
XXXXRXX

SEQ ID NO: 23223 - protein, 7 aa, Artificial Sequence
  Description of Artificial Sequence: Synthetic peptide
  MOD_RES (2)..(2): A, S, or V
  MOD_RES (4)..(4): K or R
DXSXRAT

SEQ ID NO: 23224 - protein, 7 aa, Artificial Sequence
  Description of Artificial Sequence: Synthetic peptide
DASRRAT

SEQ ID NO: 23225 - protein, 9 aa, Artificial Sequence
  Description of Artificial Sequence: Synthetic peptide
  MOD_RES (4)..(4): A or S
QQRXNWPQN

SEQ ID NO: 23226 - protein, 9 aa, Artificial Sequence
  Description of Artificial Sequence: Synthetic peptide
  MOD_RES (4)..(4): K or S
FPFXGTYMT

SEQ ID NO: 23227 - protein, 9 aa, Artificial Sequence
  Description of Artificial Sequence: Synthetic peptide
  MOD_RES (2)..(2): P or I
  MOD_RES (4)..(4): K or S
  MOD_RES (6)..(6): T or H
  MOD_RES (7)..(7): W or Y
  MOD_RES (9)..(9): T or S
FXFXGXXMX

SEQ ID NO: 23228 - protein, 16 aa, Artificial Sequence
  Description of Artificial Sequence: Synthetic peptide
IIYSGGDTYYADSVKG

SEQ ID NO: 23229 - protein, 16 aa, Artificial Sequence
  Description of Artificial Sequence: Synthetic peptide
  MOD_RES (1)..(1): V or I
  MOD_RES (2)..(2): L or I
  MOD_RES (7)..(7): D or S
  MOD_RES (13)..(13): S or A
  MOD_RES (15)..(15): K or Q
XXYSGGXTYYADXVXG

SEQ ID NO: 23230 - protein, 18 aa, Artificial Sequence
  Description of Artificial Sequence: Synthetic peptide
  MOD_RES (13)..(13): T or S
ARDREMAIITERXYGLDV

SEQ ID NO: 23231 - protein, 13 aa, Artificial Sequence
  Description of Artificial Sequence: Synthetic peptide
SGGSSNIGSNSVN

SEQ ID NO: 23232 - protein, 13 aa, Artificial Sequence
  Description of Artificial Sequence: Synthetic peptide
  MOD_RES (3)..(3): G or S
  MOD_RES (4)..(4): S or T
  MOD_RES (5)..(5): S or A
  MOD_RES (8)..(8): G or A
  MOD_RES (11)..(11): S or G
SGXXXNIXSNXVN

SEQ ID NO: 23233 - protein, 7 aa, Artificial Sequence
  Description of Artificial Sequence: Synthetic peptide
  MOD_RES (1)..(1): S or A
  MOD_RES (2)..(2): N or V
XXSQRPS

SEQ ID NO: 23234 - protein, 7 aa, Artificial Sequence
  Description of Artificial Sequence: Synthetic peptide
  MOD_RES (1)..(1): G, S, or A
  MOD_RES (2)..(2): N or V
  MOD_RES (3)..(3): S or G
  MOD_RES (4)..(4): N or Q
XXXXRPS

SEQ ID NO: 23235 - protein, 13 aa, Artificial Sequence
  Description of Artificial Sequence: Synthetic peptide
AAWDDSLNTFRYV

SEQ ID NO: 23236 - protein, 9 aa, Artificial Sequence
  Description of Artificial Sequence: Synthetic peptide
  MOD_RES (6)..(6): Y or D
GTFSSXAIS

SEQ ID NO: 23237 - protein, 9 aa, Artificial Sequence
  Description of Artificial Sequence: Synthetic peptide
  MOD_RES (2)..(2): T, S, or P
  MOD_RES (4)..(4): S or T
  MOD_RES (6)..(6): Y, F, or D
  MOD_RES (7)..(7): V, G, or A
  MOD_RES (8)..(8): V, L, or I
  MOD_RES (9)..(9): S or T
GXFXSXXXX

SEQ ID NO: 23238 - protein, 17 aa, Artificial Sequence
  Description of Artificial Sequence: Synthetic peptide
GIIPIFVTANYAQKFQG

SEQ ID NO: 23239 - protein, 17 aa, Artificial Sequence
  Description of Artificial Sequence: Synthetic peptide
  MOD_RES (3)..(3): I or M
  MOD_RES (7)..(7): G or V
  MOD_RES (9)..(9): A or T
  MOD_RES (10)..(10): N or G
  MOD_RES (17)..(17): G or D
GIXPIFXTXXYAQKFQX

SEQ ID NO: 23240 - protein, 22 aa, Artificial Sequence
  Description of Artificial Sequence: Synthetic peptide
ARGRMATIRGGQNYYYYYGMDV

SEQ ID NO: 23241 - protein, 11 aa, Artificial Sequence
  Description of Artificial Sequence: Synthetic peptide
QASQDISNYLN

SEQ ID NO: 23242 - protein, 11 aa, Artificial Sequence
  Description of Artificial Sequence: Synthetic peptide
  MOD_RES (7)..(7): S or R
  MOD_RES (8)..(8): N or K
  MOD_RES (9)..(9): Y or C
QASQDIXXXLN

SEQ ID NO: 23243 - protein, 7 aa, Artificial Sequence
  Description of Artificial Sequence: Synthetic peptide
DASNLET

SEQ ID NO: 23244 - protein, 7 aa, Artificial Sequence
  Description of Artificial Sequence: Synthetic peptide
  MOD_RES (1)..(1): V, A, S, T, D, E, K, or R
  MOD_RES (2)..(2): A, V, or T
  MOD_RES (4)..(4): S, N, T, or K
  MOD_RES (6)..(6): Q, E, K, or R
  MOD_RES (7)..(7): S, N, or T
XXSXLXX

SEQ ID NO: 23245 - protein, 9 aa, Artificial Sequence
  Description of Artificial Sequence: Synthetic peptide
QQYDNLPLT

SEQ ID NO: 23246 - protein, 9 aa, Artificial Sequence
  Description of Artificial Sequence: Synthetic peptide
  MOD_RES (3)..(3): Y or F
  MOD_RES (4)..(4): D or E
  MOD_RES (5)..(5): N or D
  MOD_RES (8)..(8): L or I
QQXXXLPXT

SEQ ID NO: 23247 - protein, 9 aa, Artificial Sequence
  Description of Artificial Sequence: Synthetic peptide
  MOD_RES (2)..(2): Q or H
  MOD_RES (3)..(3): Y, A, or F
  MOD_RES (4)..(4): D or E
  MOD_RES (5)..(5): N, S, or D
  MOD_RES (6)..(6): L, Y, or F
  MOD_RES (8)..(8): I, L, T, V, or F
  MOD_RES (9)..(9): T or A
QXXXXXPXX

SEQ ID NO: 23248 - protein, 9 aa, Artificial Sequence
  Description of Artificial Sequence: Synthetic peptide
FTFDDYAMH

SEQ ID NO: 23249 - protein, 9 aa, Artificial Sequence
  Description of Artificial Sequence: Synthetic peptide
  MOD_RES (2)..(2): T or I
  MOD_RES (3)..(3): F or L
  MOD_RES (8)..(8): M or V
FXXDDYAXH

SEQ ID NO: 23250 - protein, 17 aa, Artificial Sequence
  Description of Artificial Sequence: Synthetic peptide
  MOD_RES (8)..(8): T or S
  MOD_RES (16)..(16): M or K
GISWNSGXINYADSVXG

SEQ ID NO: 23251 - protein, 17 aa, Artificial Sequence
  Description of Artificial Sequence: Synthetic peptide
  MOD_RES (3)..(3): S or T
  MOD_RES (8)..(8): S, T, or Y
  MOD_RES (9)..(9): I or L
  MOD_RES (10)..(10): N or G
  MOD_RES (16)..(16): K or M
GIXWNSGXXXYADSVXG

SEQ ID NO: 23252 - protein, 17 aa, Artificial Sequence
  Description of Artificial Sequence: Synthetic peptide
ASDSNYRDYYYHYGMDV

SEQ ID NO: 23253 - protein, 16 aa, Artificial Sequence
  Description of Artificial Sequence: Synthetic peptide
  MOD_RES (10)..(10): N or Q
RSSQSLLHSXGYNYLD

SEQ ID NO: 23254 - protein, 7 aa, Artificial Sequence
  Description of Artificial Sequence: Synthetic peptide
LGSNRAS

SEQ ID NO: 23255 - protein, 7 aa, Artificial Sequence
  Description of Artificial Sequence: Synthetic peptide
  MOD_RES (1)..(1): L or G
  MOD_RES (2)..(2): G or N
  MOD_RES (3)..(3): S or N
  MOD_RES (4)..(4): N or E
  MOD_RES (6)..(6): A or S
XXXXRXS

SEQ ID NO: 23256 - protein, 9 aa, Artificial Sequence
  Description of Artificial Sequence: Synthetic peptide
MQALQTPRT

SEQ ID NO: 23257 - protein, 10 aa, Artificial Sequence
  Description of Artificial Sequence: Synthetic peptide
  MOD_RES (3)..(3): A or S
  MOD_RES (4)..(4): L or I
  MOD_RES (5)..(5): Q or absent
  MOD_RES (6)..(6): Q or T
  MOD_RES (7)..(7): T, P, or V
  MOD_RES (8)..(8): P or G
  MOD_RES (9)..(9): R, I, or V
MQXXXXXXXT

What is claimed is:

1. An isolated antibody, or antigen-binding fragment thereof, which specifically binds to the spike protein of a coronavirus ("CoV-S"), wherein said antibody, or antigen-binding fragment thereof, comprises a heavy chain variable region (VH) comprising a VH CDR1 comprising SEQ ID NO:22304, a VH CDR2 comprising SEQ ID NO:22306, and a VH CDR3 comprising SEQ ID NO:22308, and a light chain variable region (VL) comprising a VL CDR1 comprising SEQ ID NO:22314, a VL CDR2 comprising SEQ ID NO:22316, and a VL CDR3 comprising SEQ ID NO:22318.

2. The isolated antibody, or antigen-binding fragment thereof, of claim 1, wherein the VH comprises SEQ ID NO:22302 and the VL comprises SEQ ID NO:22312.

3. The isolated antibody, or antigen-binding fragment thereof, of claim 2, wherein the VH consists of SEQ ID NO:22302 and the VL consists of SEQ ID NO:22312.

4. The isolated antibody, or antigen-binding fragment thereof, of claim 1, wherein the CoV-S is the spike protein of SARS-CoV ("SARS-CoV-S") or the spike protein of SARS-CoV-2 ("SARS-CoV-2-S").

5. The isolated antibody, or antigen-binding fragment thereof, of claim 1, wherein the antibody, or antigen-binding fragment thereof, cross-reacts with SARS-CoV-S and SARS-CoV-2-S.

6. The isolated antibody, or antigen-binding fragment thereof, of claim 5, wherein SARS-CoV-S comprises an amino acid sequence of SEQ ID NO:1, and wherein SARS-CoV-2-S comprises an amino acid sequence of SEQ ID NO:5.

7. The isolated antibody, or antigen-binding fragment thereof, of claim 1, which neutralizes SARS-CoV and/or SARS-CoV-2.

8. The isolated antibody, or antigen-binding fragment thereof, of claim 7, which neutralizes SARS-CoV and/or SARS-CoV-2 with an IC50 of about 100 nM or lower.

9. The isolated antibody, or antigen-binding fragment thereof, of claim 1, which binds to SARS-CoV-S with a KD value of about 100 nM or lower.

10. The isolated antibody, or antigen-binding fragment thereof, of claim 1, wherein the antibody is human, humanized, primatized, chimeric, bispecific or multispecific.

11. The isolated antibody, or antigen-binding fragment thereof, of claim 1, wherein the antigen-binding fragment thereof comprises a Fab, Fab2, or scFv.

12. A pharmaceutical composition comprising the antibody, or antigen-binding fragment thereof, of claim 1, and a pharmaceutically acceptable carrier.

13. A pharmaceutical composition comprising the antibody, or antigen-binding fragment thereof, of claim 2, and a pharmaceutically acceptable carrier.

14. A pharmaceutical composition comprising the antibody, or antigen-binding fragment thereof, of claim 3, and a pharmaceutically acceptable carrier.

* * * * *